United States Patent 11,931,406 (FLAVIVIRUS VACCINE) - sequence listing, part 11

SEQ ID NO: 6478 - RNA, 9876 nt, Artificial Sequence
  derived and/or modified CDS sequence (wt) from DENV-2__FJ024473__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaacaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucugaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcgaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauauucuauguguacaggaaaguuuaaaauugugaaagaaauagcagaaacacaacauggaacaauaguuaucagaguacaauaugaaggggacgguucuccauguaagauccccuuugagauaacagacuuggaaaaaagacacgucuuaggucgccugauuacaguuaacccaaucguaauagaaaaagauagcccagucaacauagaagcagaaccuccauucggagauagcuacaucauuauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaaucuccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauacuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcaguaauacugcgaaacgcauggaaggugaguugcacgauauuggcagcgguguccguuucuccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaaacaacacugaccauacucaucagaacgggauuguuggugaucucaggagucuuuccaguaucgauaccaaucacggcagcagcaugguaccugugggaagugaagaaacaacgggcuggaguauugugggacgucccuucacccccacuagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugacuaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaauaccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccguugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagccgcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacaguguuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuucuaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggauggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauacaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgaggcagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguaugccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaacauggaagcccaauuaauuagacagauggagggagaaggaaucuucaaaagcauucagcaccugacagccacagaagaaaucgcugcacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccauguagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6479 - RNA, 9876 nt, Artificial Sequence
  derived and/or modified CDS sequence (wt) from DENV-2__FJ024474__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucaaacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucugaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacauaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauauucuauguguacaggaaaguuuaaaauugugaaagaaauagcagaaacacaacauggaacaauaguuaucagaguacaauaugaaggggacgguucuccguguaagauccccuuugagauaacagacuuggaaaaaagacacgucuuaggucgccugauuacaguuaacccaaucguaauagaaaaagauagcccagucaacauagaagcagaaccuccauucggagauagcuacaucauuauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaaucuccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauacuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcaguaauacugcgaaacgcauggaaggugaguugcacgauauuggcagcggcguccguuucuccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagggcugccgauguaaaaugggaagaucaggcagaaauaucaggaagcagcccaauccugucaauaacaauaucagaagauggcagcaugucgauaaaaaaugaagaggaagaacaaauacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacacauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccguugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugacggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuucuaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggauggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauacaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguaugccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcugcacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccauguagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6480 - RNA, 9876 nt, Artificial Sequence
  derived and/or modified CDS sequence (wt) from DENV-2__FJ024475__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucucaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcgaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauauucuauguguacaggaaaguuuaaaauugugaaagaaauagcagaaacacaacauggaacaauaguuaucagaguacaauaugaaggggacgguucuccauguaagauccccuuugagauaacagacuuggaaaaaagacacgucuuaggucgccugauuacaguuaacccaaucguaauagaaaaagauagcccagucaacauagaagcagaaccuccauucggagauagcuacaucauuauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaaucuccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauacuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcaguaauacugcgaaacgcauggaaggugaguugcacgauauuggcagcgguguccguuucuccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaaacaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugacuaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccguugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagccgcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuaugacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuucuaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggauggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauacaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguaugccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauauuauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcugcacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccauguagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6481 - RNA, 9867 nt, Artificial Sequence
  derived and/or modified CDS sequence (wt) from DENV-2__FJ182012__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucugaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacaacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauauucuauguguacaggaaaguuuaaaauugugaaagaaauagcagaaacacaacauggaacaauaguuaucagaguacaauaugaaggggacgguucuccauguaagauccccuuugagauaacagacuuggaaaaaagacacgucuuaggucgccugauuacaguuaacccaaucguaauagaaaaagauagcccagucaacauagaagcagaaccuccauucggagauagcuacaucauuauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaaucuccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauacuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcaguaauacugcgaaacgcauggaaggugaguugcacgauauuggcagcgguguccguuucuccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagggcugccgauguaaaaugggaagaucaggcagaaauaucaggaagcagcccaauccugucaauaacaauaucagaagauggcagcaugucgauaaaaaaugaagaggaagaacaaauacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacacauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccguugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuucauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuucuaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggauggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauacaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguaugccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcugcacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccauguagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6482 - RNA, 9876 nt, Artificial Sequence
  derived and/or modified CDS sequence (wt) from DENV-2__EU854293__SS-prME
acugcaggcaugaucauuaugcugauuccaacagugauggcguuccauuuaaccacacguaacggagaaccacacaugaucgucaguagacaagagaaagggaaaagucuucuguuuaaaacaggggauggugugaacauguguacccucauggccauggaccuuggugaauugugugaagauacaaucacguacaaguguccucuucucaggcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaucugccacucuaaggaaguacuguauagaggcaaagcugaccaacacaacaacagaaucucgcugcccaacacaaggagaacccagccuaaaugaagagcaggacaaaagguucgucugcaaacacuccaugguggacagaggauggggaaauggauguggauuauuuggaaaaggaggcauugugaccugugcuauguucacaugcaaaaagaacaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaggcagaaccuccauucggagacagcuacaucaucauaggaguagagccgggacaauugaagcucaacugguuuaagaaaggaaguucuaucggccaaauguuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggacuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcggccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaaugaagugcuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaauacugaccauacucauuagaacaggauugcuggugaucucaggacuuuuuccuguaucaaugccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacgggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccucaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6483 - RNA, 9876 nt, Artificial Sequence
  derived and/or modified CDS sequence (wt) from DENV-2__EU854294__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucugaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauauucuauguguacaggaaaguuuaaaauugugaaagaaauagcagaaacacaacauggaacaauaguuaucagaguacaauaugaaggggacgguucuccauguaagauccccuuugagauaacagacuuggaaaaaagacacgucuuaggucgccugauuacaguuaacccaaucguaauagaaaaagauagcccagucaacauagaagcagaaccuccauucggagauagcuacaucauuauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaaucuccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauacuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcaguaauacugcgaaacgcauggaaggugaguugcacgauauuggcagcgguguccguuucuccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccguugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuucuaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggauggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauacaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguaugccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcugcacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccauguagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6484 - RNA, 9876 nt, Artificial Sequence
  derived and/or modified CDS sequence (wt) from DENV-2__FJ024477__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucaccuacaaguguccucuccucagacaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugauauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccuugacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgccugaucacaguuaacccaaucguaacagaaaaagauagcccagucaacauagaagcagaaccuccauucggggacagcuacaucaucauaggaguagagccgggacaauugaaacucaauugguuuaagaagggaaguuccaucggccaaauguucgagacaacaaugagaggagcaaagagaauggcuauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauaguggcugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucagcaacaagauuggagaaccugauguggaaacaaauaacaccagaauugaaucauauucuaucagaaaaugagguaaaguugaccauuaugacaggagacauuaaaggaaucaugcaagcaggaaaacgauccuugcggccccagcccacugagcugaaguacucauggaaaacauggggaaaggcgaaaaugcucuccacagagucucacaaucagaccuuucuuauugauggcccugaaacagcagaaugccccaauacaaacagagcuuggaacucacuggaaguugaagacuaugguuuuggaguuuuuacuaccaauauauggcuaaaauugagagaaaaacaggauguauuuugugacucaaaacucaugucagcggccaucaaagacaacagagccguucacgccgauauggguuauuggauagaaagcgcacucaaugacacauggaagauggagaaagccuccuucauugaaguuaaaagcugccauuggccaaagucacacacccucuggagcaauggaguauuagaaagugagaugauaauuccaaaaaacuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacucuuuggucacagccggacaugggcagauugacaacuuuucacuaggagucuugggaauggcacuguuccuggaagaaaugcucaggacccgaguaggaacgaaacaugcaauacugcuagcugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaagaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccgaaugcagugauacugcaaaacgcauggaaggugaguugcacaauauuggcagugguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggcugauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaauuaagcaaagagggauucuuggauauucucagauuggagccggaguuuacaaagaaggaacauuccauacaauguggcacgucacacguggugcuguccugaugcauagagggaagaggauugaaccaucaugggcagaugucaagaaagaccuaauaucauauggaggaggcuggaagcuagaaggagaguggaaggaaggagaggaaguccaaguccuggcauuggaaccugggaaaaauccaagagccguccaaacaaaaccuggaauuuucaaaaccaacaccggaaccauaggcgccguaucucuggacuuuuccccuggaacgucaggaucuccaauugucgacagaaaaggaaagguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucaaagccgaacacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaauuucaaggcugagaggguuauagaccccagacguugcaugaaaccagucauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacucuggagacacugcuucuacugacacuccuggcaacagucacaggaggaaucuucuuauucuuaaugagcggaaaagguauagggaagaugacccugggaauguguugcauaaucacggcuaguguccuccuaugguaugcacagauacaaccacacuggauagcagcuucaauaauacuggaguuuuuucucauaguuuugcucauuccagagccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggccacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauaggcccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaacccuagcgaccgggcccaucuccacacugugggaaggaaauccagggagguuuuggaacaccaccaucgcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcgcugggaaaaagugaauuucagaucuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaagcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagcugaggccauauucaaauuaacguaccaaaauaagguggugcgugugcaaagaccaacaccaagaggcacaguaauggauaucauaucgagaagagaccaaagaggcagugggcaagucggcaccuauggccuuaauacuuucaccaauauggaagcccaauuaaucagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggcuuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguucugugguag

SEQ ID NO: 6485 - RNA, 9876 nt, Artificial Sequence
  derived and/or modified CDS sequence (wt) from DENV-2__GQ868552__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagacacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggaaacacgaacugaaacauggaugucaucagaaggggccuggaaacauguucagagaauugaaaccuggaucuugagacauccaggcuuugccauaauggcagcaauccuggcauacaccauaggaacgacacauuuccaaagggccuugauuuucaucuuauugacagcugucgcuccuucaaugacaaugcguugcauaggaauaucaaauagagacuucguagaagggguuucaggaggaagcuggguugacauagucuuagaacauggaaguugugugacgacgauggcaaaaaacaaaccaacacuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcugccagaaaaucuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagaugguguugcugcagauggaagagaaagcuuggcuggugcacaggcaaugguucuuagaccugccguuaccauggcuaccuggagcggacacacaaggaucaaauuggauacagaaagagacauuggucacuuuuaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacugcagcucaaaggaaugucauacucuauguguacaggaaaguuuaaaauugugaaagaaauagcagaaacacaacauggaacaauaguuaucagaguacaauaugaaggggacggcucuccauguaagaucccuuuugagauaauggauuuggaaaaaagacacgucuugggucgccugauuacagucaacccaaucguaacagaaaaagauagcccagucaacauagaagcagaaccuccauucggagacaguuacaucaucauaggaguagagccgggacaauugaaacucaauugguuuaagaagggaaguuccaucggucaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguacuggugggagucgugacacuguaccugggagcuauggugcaggcugacagugguugcguugugagcuggaaaaacaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauccuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcuuuccacagagucucacaaucagaccuuucuuauugauggcccugaaacagcagaaugccccaacacaaacagagcuuggaacucgcuggaaguugaagacuaugguuuuggagucuuuaccaccaauauauggcuaaaacugagagaaaaacaggauguguuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggaguaauggaguauuggaaagugagaugauaauuccaaaaaauuuugcuggaccagugucacaacacaacuacagaccaggcuaccauacacaaacagcaggaccuuggcaucuagguaagcuugagauggacuucgauuucugcgaaggaaccacagugguggugaccgaggacuguggaaauagaggacccucuuuaagaacgaccacugccucuggaaaacucauaacagaauggugcugccgaucuugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauagcacuguuccuggaagagaugcucaggacccgaguaggaacgaaacaugcaauacugcuaguugcaauaucuuuugugacauugauuacugggaacaugucuuuuagagaccugggaagagugaugguuauggugggcgcuaccaugacggaugacauagguaugggagugacuuaccuugcccuauuagcagcuuucaaaguuagaccaacuuucgcagcuggacuacucuugagaaggcugaccuccaaggaacuaaugauggccaccauaggaaucgcacuucuuucccaaagcaccauaccagagaccauucuagaacugacugaugcguuagccuugggcaugaugguccucaaaauagugagaaauauggaaaaguaccaauuggcagugacuaucauggcuaucucgugugucccaaaugcagugauacugcuaaacgcauggaaggugaguugcacaauauuggcagcgguauccguuucuccauugcucuuaacauccucacagcagaaagcggacuggauaccacuggcacugacgauaaaaggucucaauccgacagccaucuuucuaacaacucuuucgagaaccagcaagaaaaggagcuggccgcuaaaugaagcugucauggcagucgggauggugagcauuuuagccaguucucuccuaaagaaugacauucccaugacggguccauugguggcuggagggcuccuuacuguguguuacgugcucacuggacgaucggccgauuuggaacuggagagagccgccgauguaaaaugggaagaucacgcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaauuacggcagcagcaugguaccuaugggaagugaagaaacaacgggcuggaguauugugggacgucccuucaccuccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaaguuggaaggagaauggaaagaaggagaggaaguccaaguccuggcauuggaaccuggaaaaaauccaagagccguccaaacgaaaccuggacuuuucaaaaccaacaccggaaccauaggcgccguaucucuggacuuuuccccuggaaccucaggaucuccaauugucgacagaaaaggaaaaguugugggucuuuaugguaaugguguugucacaaggaguggagcauaugugagugcuauagcccagaccgaaaaaagcauugaaaacaauccagagaucgaagaugacauuuuccgaaagaaaagacugaccauuauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacacugggcgggagaucguggaccuaaugugucaugccacauuuacuaugaggcugcuaucaccagucagagugccaaauuacaaucugaucauuauggacgaagcccacuucacagauccagcaaguauagcagcuagaggauauauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuucaaagggaagacuguuugguuuguuccaaguauaaaagcaggaaaugacauagcagcuugccuuagaaaaaauggaaagaaagugauacaacucaguaggaagacuuuugacucugaguauguuaagacuagagccaaugauugggauuuuguggucacaacugacauuucagaaaugggugccaacuucagggcugagaggguuauagaucccagacguugcaugaaaccagucauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguuugaaccagagcgugaaaagguggaugccauugauggugaauaccguuugagaggagaagcaaggaaaaccuuuguggaccuaaugagaagaggggacuuaccaguaugguuggccuacagaguggcagcugaagguaucaacuacgcagacagaaggugguguuuugauggaauuaagaacaaccaaauacuggaagaaaacguggaaguggaaaucuggacgaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuaucugugcugcauacggcugaggcagguggaagggcguacaaucaugcucucagugaacugccagagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacaguaguggccgcaaccauggcaaaugagauggguuuccuggaaaaaaccaagaaagaccucggauugggaagcauuacaacccaggaaccugagaguaacauccuggacauagauuuacguccugcaucagcauggacguuguaugccguggcuacaacauuuguuacaccaauguugagacauagcauugaaaauuccucagugaaugucucccuaacagccauugcuaaucaagcuacagugcuaaugggucuuggaaaaggauggccauugucaaagauggacaucggaguuccccuccuugccauuggaugcuauucacaagucaacccuauaacucucacagcagcccuucuuuuauugguagcacauuaugccauuauagggccaggacuucaggcaaaagcaacuagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcuaccgggcccaucuccacacugugggaaggaaauccagggagguuuuggaacacuaccauugcagugucaauggcuaacaucuuuagggggagcuacuuggcuggagcuggacuucucuucuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuacugcgggggacuaaagaaugugagagaagucaaaggccugacaaaaggaggaccaggacacgaagaacccauccccaugucaacauauggguggaaucuagugcgucugcaaagugggguugacguuuucuucaccccgccagaaaagugugauacauuguuaugugacauaggggagucgucaccaaaucccacgauagaagcaggacgaacacucagaguccucaacuuaguggaaaauugguugaacaacaacacccaauucugcauaaagguucucaacccauauaugcccucagucauagagaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaaacaagagcaugaaacaucauggcacuaugaccaagaccacccauacaaaacgugggcuuaccauggcagcuaugaaacaaaacaaacuggaucagcaucaucuaugguaaacggaguggucagacugcugacaaaaccuugggacgucgucccuauggugacacagauggcaaugacagacacgacuccuuuuggacaacaacgcguuuucaaagagaaaguggacacgagaacccaagaaccgaaggaaggcacaaagaaauugaugaaaaucacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaagaagggggagcaauguacgccgaugauacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagcgggcaagucggcaccuauggccuuaauacuuucacuaacauggaagcucaauuaauuagacagauggagggagaaggaaucuucaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgacuggacacaagugccuuucuguucacaucauuuucacgaguuagucaugaaagauggucgcgugcucguagucccaugcagaaaccaagaugaacugauuggcagagcccgaauuucucaaggagccggguggucuuuaaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcacgaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucucuuauaggcaaugaggaauacacagacuacaugccauccaugaagagauucagaagggaagaggaagaggcagguguccugugguag

SEQ ID NO: 6486 - RNA, 9876 nt, Artificial Sequence
  derived and/or modified CDS sequence (wt) from DENV-2__GQ868553__SS-prME
acagcaggcgugauuguuauguugauuccgacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaaaaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaguaacaccagaauugaaucauauucuaucagaaaaugagguaaaguugaccauuaugacaggagacauuaaaggaaucaugcaggcaggaaaacgauccuugcggccccagcccacugagcugaaguauucauggaaaacauggggaaaggcgaaaaugcucuccacagagucucacaaucagaccuuucucauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaacuuugccgggccggugucacaacacaacuacagaccaggcuaccauacacaaacaguaggaccuuggcaucuagguaaacuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucauuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauuuuugaacugacugaugcguuagccuugggcaugaugguccucaaaauagugagaaauauggaaaaauaccaauuggcagugacuaucauggcuauuucgugugucccaaaugcagugauacugcaaaaugcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaauacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagaggaaagaggauugaaccaucaugggcagaugucaagaaagaccuaauaucauauggaggaggcuggaagcuagaaggagaauggaaggaaggagaggaaguccaaguccuggcauuggaaccugggaaaaauccaagagccguccaaacgaaaccuggaauuuucagaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaacuccagccaucaaagccgagcacaccgggcgggagaucguggaccuaaugugucaugccacauuuaccaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucuuaggaaaaauggaaagaaagugauacaacucaguaggaagacuuuugacucugaauauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacaaauacaaccacacuggauagcagccucaauaauacuggaguuuuuucucauaguuuugcucaucccagaaccagaaaaacagagaacaccccaagacaaccaauugaccuacguagucauagccauccucacagugguggccgcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuucuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucagaucuacaagaaaaguggaauccaggaaguggauagaacccuagcaaaagaaggcauuaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaauacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaggaaggcacgaagaagcugaugaaaaucacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcugcacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccaucuaugaagagauucagaagggaagaggaagaggcagguguccugugguag

SEQ ID NO: 6487 - RNA, 9876 nt, Artificial Sequence
  derived and/or modified CDS sequence (wt) from DENV-2__GQ868554__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcuguugcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucugaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacaguagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaauuaaugauggccaccauaggaaucacacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacguuccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaaaaaaagauugaccaucauggaccuccauccaggagcaggaaagacaaaaagauaccuuccagccauagucagagaagccauaaaacguggcuugagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaagacuuuugacucugaguauguuaagacuagagccaaugauugggacuuuguggucacgacugacauuucagaaaugggugccaacuucaaagcugagaggguuauagaccccagacguugcaugaaaccaguuauauuaacagauggcgaagagcgggugaucuuggcaggaccuaugccagugacccacucuagugcagcgcaaagaagagggagaauaggaagaaauccaaaaaaugaaaacgaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuucguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacucuuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaauguuucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccaucauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggcuauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6488 - RNA, 9876 nt, Artificial Sequence
  derived and/or modified CDS sequence (wt) from DENV-2__GQ868555__SS-prME
acagcaggcgugauuguuauguugauuccaacagcgauagcguuccauuuaaccacacgcaauggagaaccacacaugaucguugguaggcaggagaaagggaaaagucuucuguucaaaacagaggaugguguuaacauguguacccucauggccauagaccucggugaauugugugaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggaugggggaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguggguaaugacacaggaaaacacggcaaggaaaucaaaauaacaccacagaguuccaucacagaagcagaacugacaggcuauggcacugucacgauggagugcucuccgagaacgggccucgacuucaaugagauggugcugcugcagauggaagacaaggcuuggcuggugcacaggcaaugguuccuagaccugccguugccauggcuaccuggagcugacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggacgggucuccauguaagaucccuuuugagauaacagacuuggaaaaaagacaugucuuaggucgccugauuacaguuaacccaaucguaacagaaaaagauagcccagucaacauagaagcagaaccuccauucggagacagcuacauuaucauaggaguagagccgggacaacugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucucauugauggcccugaaacagcagaaugccccaacacaaauagagccuggaacucgcuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuaggcaagcuugagauggacuuugaucucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacaggcccauuaguggcuggagggcuccuuaccguauguuacgugcucacuggacgaucggccgauuuggaacuggagagagcugccgagguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggaaggagccuacagaaucaagcaaagagggauucuuggauauucucagauuggagccggaguuuacaaagagggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaagucuuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucaaagccgagcauacugggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucucaggaaaaauggaaagaaagugauacaacucaguaggaagacuuuugacucugaguauguuaagacuagagccaaugauugggacuuuguggucacgacugacauuucagaaaugggugccaacuucaaagcugagaggguaauagaccccagacguugcaugaaaccaguuauacuaacagauggcgaagagcgggugaucuuggcgggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggauauauucugacccacuggcacuaaaagaauuuaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggccaguguccuccuaugguaugcacagauacaaccacacuggauagcagcuucaauaauacuggaguuuuuucucauagucuugcuuauuccagaaccagaaaaacagagaacaccccaagacaaccaauugaccuacguugucauagccauccucacagugguggcugcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccguugucaaagauggacaucggaguuccccuccuugccaucggaugcuacucacaagucaacccuauaacucucacagcagcucuucuuuuauugguagcacauuaugccauuauagggccaggacuccaagcaaaagcaaccagagaagcacagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacccaaguauuaaugaugaggacuacaugggcuuugugugaggcucuaaccuuagcgaccgggcccaucuccacauugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacugaagaauguaagagaagucaaaggccuaacaaaaggaggaccaggacacgaagaacccaucccuaugucaacauauggguggaauuuagugcgucugcaaagcggaguugacguuuucuucaccccgccagaaaaaugugauacauuguugugugacauaggggagucgucaccaaauccuacgauagaagcaggacgaacacucagaguccucaacuuaguagaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugaaaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggagaguucggcaaggcaaaaggcagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauagaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugauaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucagcagucccgucacauuggguuccaacaagucgaacaaccugguccauacaugcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauagggcuaacaagcagggcuaccugggcgaagaacauccagacagcaauaaaucaagucagaucccucauaggcaaugaggaauacacagacuacaugccauccaugaagagauucagaagggaagaggaagaggcagguguccugugguag

SEQ ID NO: 6489 - RNA, 9876 nt, Artificial Sequence
  derived and/or modified CDS sequence (wt) from DENV-2__GQ868556__SS-prME
acagcaggcgugaucguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaaucuuggcauacaccauaggaacgacacauuuccaaagggccuugauuuucaucuuacugacagcugucgcuccuucaaugacaaugcgcugcauaggaauaucaaauagagacuucguggaagggguuucaggagggagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcugugggcaaugacacaggaaaacacggcaaggaaaucaaaauaacaccacagaguuccaucacagaagcagaacugacaggcuauggcacuguuacgauggagugcucuccgagaacgggccucgacuucaaugagauggugcugcugcagauggaagacaaagcuuggcuggugcacaggcaaugguuccuagaccugccauuaccauggcuaccuggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcagacugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaacccaaucguaauagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuacggggcugcuuuuaguggggucucauggacuaugaaaauccucauaggagucgucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagcuuggaacucguuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucaccgccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucacacuccuuucccaaaguaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaaaaaugauauucccaugacaggcccauuaguggcuggagggcuucuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggugccgugucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccggaaaaaaagauugaccaucauggaccuccauccaggagcaggaaagacaaaaagauaccuuccagccauagucagagaagccauaaaacguggcuuaagaacauuaauucuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuuuacagacccagcaaguauagcagcuagaggauacauuucaacucgaguagagaugggugaagcagccgggauuuucaugacagccacuccuccgggaaguagagacccauuuccucagagcaaugcaccaauaauggaugaggaaagggaaaucccugagcguucguggaauucaggacaugaaugggucacggauuuuaaggggaagacuguuugguuuguuccaaguauaaaagcaggaaaugauauagcagcuugucucaggaaaaauggaaagaaagugauacaacucaguaggaaaacuuuugacucugaguauguuaagacuagagccaaugauugggacuuuguggucacgacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaauuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcacacggcugaggcagguggaagggcguacaaucaugcucucagugaacugccggagacccuggagacacugcuucuacugacacuucuggcaacagucacaggaggaaucuuccuauucuuaaugagcggaaaagguauagggaagaugacccugggaauguguugcauaaucacggcuaguguccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuccaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaggggaaggugguggaucucgguugcggcagagggggcuggucauacuauugugggggacuaaagaauguaagagaagucaaaggucuaacaaaaggaggaccaggacacgaagaacccaucccuaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugagaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaauuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaaugauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaaguccuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauaccugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaaaagauucagaagggaagaggaagaggcagguguccugugguag

SEQ ID NO: 6490 - RNA, 9876 nt, Artificial Sequence
  derived and/or modified CDS sequence (wt) from DENV-2__GQ868557__SS-prME
acagcaggcgugauuguuauguugauuccaacagcgauagcguuccauuuaaccacacgcaauggagaaccacacaugaucguugguaggcaggagaaagggaaaagucuucuguucaaaacagaggaugguguuaacauguguacccucauggccauagaccucggugaauugugugaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggaugggggaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguggguaaugacacaggaaaacacggcaaggaaaucaaaauaacaccacagaguuccaucacagaagcagaacugacaggcuauggcacugucacgauggagugcucuccgagaacgggccucgacuucaaugagauggugcugcugcagauggaagacaaggcuuggcuggugcacaggcaaugguuccuagaccugccguugccauggcuaccuggagcugacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggacgggucuccauguaagaucccuuuugagauaacagacuuggaaaaaagacaugucuuaggucgccugauuacaguuaacccaaucguaacagaaaaagauagcccagucaacauagaagcagaaccuccauucggagacagcuacauuaucauaggaguagagccgggacaacugaaacucaauugguuuaagaagggaaguuccaucggccaaauguucgagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaagcugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucucauugauggcccugaaacagcagaaugccccaacacaaauagagccuggaacucgcuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuaggcaagcuugagauggacuuugaucucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacaggcccauuaguggcuggagggcuccuuaccguauguuacgugcucacuggacgaucggccgauuuggaacuggagagagcugccgagguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagagggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucaaagccgagcauacugggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacagauuuuaaggggaagacuguuugguuuguuccaaguauaaaagcaggaaaugacauagcagcuugucucaggaaaaauggaaagaaagugauacaacucaguaggaagacuuuugacucugaguauguuaagacuagagccaaugauugggacuuuguggucacgacugacauuucagaaaugggugccaacuucaaagcugagaggguaauagaccccagacguugcaugaaaccaguuauacuaacagauggcgaagagcgggugaucuuggcgggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggauauauucugacccacuggcacuaaaagaauucaaggaauuugcagcuggaagaaaaucuuugacccugaaccuaaucacagaaaugggcaggcuuccaacuuucaugacgcagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuuccuauucuuaaugagcggaaaagguauagggaagaugacccugggaauguguugcauaaucacggccaguguccuccuaugguaugcacagauacaaccacacuggauagcagcuucaauaauacuggaguuuuuucucauagucuugcuuauuccagaaccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccguugucaaagauggacaucggaguuccccuccuugccaucggaugcuacucacaagucaacccuauaacucucacagcagcucuucuuuuauugguagcacauuaugccauuauagggccaggacuccaagcaaaagcaaccagagaagcacagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacccaaguauuaaugaugaggacuacaugggcuuugugugaggcucuaaccuuagcgaccgggcccaucuccacauugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacugaagaauguaagagaagucaaaggccuaacaaaaggaggaccaggacacgaagaacccaucccuaugucaacauauggguggaauuuagugcgucugcaaagcggaguugacguuuuuuucaccccgccagaaaaaugugauacauuguugugugacauaggggagucgucaccaaauccuacgauagaagcaggacgaacacucagaguccucaacuuaguagaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuuuaaagagaaaguagacacgagaacccaagaaccgaaagaaggcacaaagaagcugaugaaaaucacggcagaguggcuuuggaaagaacuaggaaagaaaaagaccccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggagaguucggcaaggcaaaaggcagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccacagaagaaaacgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucagcagucccgucacauuggguuccaacaagucgaacaaccugguccauacaugcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauagggcuaacaagcagggcuaccugggcgaagaacauccagacagcaauaaaucaagucagaucccucauaggcaaugaggaauacacagacuacaugccauccaugaagagauucagaagggaagaggaagaggcagguguccugugguag

SEQ ID NO: 6491 - RNA, 9876 nt, Artificial Sequence
  derived and/or modified CDS sequence (wt) from DENV-2__GU131947__SS-prME
acagcaggcgugauuguuauguugauuccaacagcgauagcguuccacuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggaugggggaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguggguaaugacacaggaaaacacggcaaggaaaucaaaauaacaccacagaguuccaucacagaagcagaacugacaggcuauggcacugucacgauggagugcucuccaagaacgggccucgacuucaaugagauggugcugcugcagauggaagacaaagcuuggcuggugcacaggcaaugguuccuagaccugccguugccauggcuaccuggagcugacacacaaggaucaaauuggauacagaaagagacauuggucacuuucaaaaauccccacgcgaagaaacaggaugucguuguccuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggaugguucuccauguaagaucccuuuugagauaacagacuuggaaaaaagacacgucuuaggucgccugauuacaguuaacccaaucguaacagaaaaagauagcccagucaacauagaagcagaaccuccauucggagacagcuacaucaucauaggaguagagccgggacaacugaaacucaauugguuuaagaagggaaguuccaucggccaaauguucgagacaacaaugagaggggcaaagagaauggccauuuuaggugacacagccugggauuuuggaucccugggaggaguguucacauccauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagccauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaauagagccuggaacucgcuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuaggcaagcuugagauggacuuugaucucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugagcugacugaugcguuagcccugggcaugaugguccucaaaauagugagaaauauggaaaaauaccaauuggcagugacuaucauggcuauuucgugugucccaaaugcaaugauacugcgaaacgcauggaaggugaguugcacgauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuggccaguucucuccuaaagaaugauauucccaugacaggcccauuaguggcuggagggcuccuuaccguguguuacgugcucacuggacgaucggccgauuuggaacuggagagagcugccgagguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaagagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcccccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagauccugcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucucaggaaaaauggaaagaaagugauacaacucaguaggaagacuuuugacucugaguauguuaagacuagagccaaugauugggacuuuguggucacgacugacauuucagaaaugggugccaacuucaaagcugagaggguaauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuugacccugaaccuaaucacagaaaugggcaggcuuccaacuuucaugacucagaaagcaagaaacgcacuggacaacuuggcugugcugcauacggcugaggcagguggaagggcguacaaucaugcccuuagugaacugccggagacccuggagacacugcuucuacugacacuccuggcaacagucacaggaggaaucuuccuauucuuaaugagcggaaaagguauagggaagaugacccugggaauguguugcauaaucacggccaguguccuccuaugguaugcacagauacaaccacacuggauagcagccucaauaauacuggaguuuuuucucauagucuugcucauuccagaaccagaaaaacagagaacaccccaagacaaccaauugaccuacguugucauagccauccucacagugguggcugcaaccauggcaaacgagauggguuuccuggaaaaaaccaagaaagaccucggacugggaagcauuacaacccaggaaucugagagcaacauccuagacauagaucuacgcccugcaucagcauggacgcuguaugccguggcuacaacauuuguuacaccaauguugagacauagcauugaaaauuccucagugaaugucucccuaacagccauugcuaaccaagcuacagugcuaaugggucuugggaaaggauggccauugucaaagauggacaucggaguuccccuccucgccaucggaugcuacucacaagucaacccuauaacucucacagcagcucuucuucuauugguagcacauuaugccauuauagggccaggacuccaagcaaaagcaaccagagaagcacagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccacgcugugucgcgagguucagcaaaacugagaugguucgucgagagaaauauggucacaccggaagggaaggugguggaucucgguuguggcagagggggcuggucauacuauugugggggacugaagaauguaagagaagucaaaggccuaacaaaaggaggaccaggacacgaagaacccaucccuaugucaacauauggguggaauuuagugcgucugcaaagcggaguugacguuuucuucaccccgccagaaaaaugugauacauuguugugugacauaggggagucgucaccaaaucccacgauagaagcaggacgaacacucagaguccucaacuuaguagaaaauugguugaacaacaacacccaauuuugcauaaagguccucaacccauauaugcccucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaagacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauucggacaacagcgcguuuuuaaagagaaaguagacacgagaacccaagaaccgaaagaaggcacuaagaagcugaugaaaaucacggcagaguggcuuuggaaagaacuaggaaagaaaaagaccccuagaauguguaccagagaagaauucacaagaaaagugagaagcaaugcagccuugggggcuauauucacugaugagaacaaauggaaaucggcacgugaggcuguugaagaugguagguuuugggaguugguugacagggaaagaaaucuccaucuugaaggaaagugugaaacauguguguacaacaugaugggaaaaagagagaagaaacuaggagaguucggcaaggcaaaaggcagcagagccauaugguacauguggcuuggagcgcgcuucuuagaguuugaagcccuaggauuccugaaugaagaucacugguucuccagagggaacuccuugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccauagaagaaaucgcuguacagaacugguuagcaagaguggggcgugaaaggcuaucaagaauggcaaucaguggagaugauuguguuguaaaacccauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6492 - RNA, 9876 nt, Artificial Sequence
  derived and/or modified CDS sequence (wt) from DENV-2__GQ868558__SS-prME
acagcaggcgugauuguuauguugauuccaacagcgauagcguuccauuuaaccacacgcaauggagaaccacacaugaucguugguaggcaggagaaagggaaaagccuucuguucaaaacagaggaugguguuaacauguguacccucauggccauagaccuuggugaauugugugaagauacaaucacguacaaguguccucuccucaaacaaaaugaaccagaagacauagauuguuggugcaacuccacguccacauggguaacuuaugggacauguaccaccacaggagaacacagaagagaaaaaagaucaguggcgcucguuccucacguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguggaagggguuucaggaggaagcuggguugacauagucuuagaacauggaaguugugugacgacgauggcgaaaaacaaaccaacauuggauuuugaacugauaaaaacagaagccaaacaaccugccacucuaaggaaguacuguauagaagcaaagcugaccaacacaacgacagaaucgcguugcccaacacaaggggaacccagucuaaacgaagagcaggacaaaagguucaucugcaaacacuccaugguagacagaggaugggggaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguggguaaugacacaggaaaacacggcaaggaaaucaaaauaacaccacagaguuccaucacagaagcagaacugacaggcuauggcacugucacgauggagugcucuccgagaacgggucucgacuucaaugagauggugcugcugcagauggaagacaaagcuuggcuggugcacaggcaaugguuccuagaccugccguugccauggcuaccuggagcugacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaagaaauagcagaaacacaacauggaacaauaguuaucagaguacaauaugaaggggacgguucuccauguaagaucccuuuugagauaacagacuuggaaaaaagacacgucuuaggucgccugauuacaguuaauccaaucguaacagaaaaagauagcccagucaacauagaagcagaaccuccauucggagacagcuacaucaucauaggaguagagccgggacaacugaaacucaauugguuuaagaagggaaguuccaucggccaaauguucgagacaacaaugagaggggcaaagagaauggccauuuuaggugacacagccugggauuuuggaucccugggaggaguguucacauccauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggagucgugacauuauaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacacuaaaggaaucaugcaggcaggaaaacgauccuugcggccccagcccacugagcugaaguacucauggaaaacauggggaaaggcgaaaaugcacuccacagagucucacaaucagaccuuucuuauugauggcccugaaacagcagaaugccccaacacaaauagagccuggaacucgcuggaaguugaagacuaugguuuuggaguuuuuaccaccaauauauggcuaaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguaaaaagcugccacuggccaaagucacacacccucuggagcaauggaguauuagaaagugagaugauaauuccaaaaaauuuugccgggccagugucacaacacaacuacagaccagguuaccauacacaaacagcaggaccuuggcaucuaggcaagcuugagauggacuuugaucucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagaucgacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugagcugacugaugcguuagccuugggcaugaugguccucaaaauagugagaaauauggaaaaauaccaauuggcagugacuaucauggcuauuucgugcgucccaaaugcagugauacugcgaaacgcauggaaggugaguugcacgauauuggcagcgguguccguuucuccacugcucuuaacauccucacagcagaaagcggauuggauaccacugguauugacgauaaaaggucucaauccaacagccauuuuucuaacaacucuuucgagaaccagcaagaaaaggagcuggccacuaaaugaagcuaucauggcagucgggauggugagcauuuuagccaguucucuccuaaagaaugauauucccaugacaggcccauuaguggcuggagggcuccuuaccguguguuacgugcucacuggacgaucggccgauuuggaacuggagagagcugccgagguaaaaugggaagaucaggcagaaauaucaggaagcagcccaauccugucaauaacaauaucagaagauggcagcaugucgauaaagaaugaagaggaagaacaaacacugaccauacucaucagaacgggauuguuggugaucucaggagucuuuccaguaucgauaccaaucacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacgccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucaaagccgagcauaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugucucaggaaaaauggaaagaaagugauacaacucaguaggaagacuuuugacucugaguauguuaagacuagagccaaugauugggacuuuguggucacgacugacauuucagaaaugggugccaacuucaaagcugagaggguaauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucucgaaaaugaugaagacugugcacauuggaaagaagcuaaaaugcuccuagacaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaauuaagaacaaccaaauacuggaagaaaauguggaaguggaaaucuggacaaaagaaggggaaaggaaaaaacuaaaacccagaugguuggaugcuaggaucuauucugacccacuggcacuaaaagaauucaaggaauuugcagcuggaagaaaaucuuuaacccugaaccuaaucacagaaaugggcaggcuuccaacuuucaugacucagaaagcaagaaacgcacuggacaacuuggcugugcugcauacggcugaggcagguggaagggcguacaaucaugcucuuagugaacugccggagacccuggagacacugcuucuacugacacuccuggcaacagucacaggaggaaucuuccuauucuuaaugagcggaaaagguauagggaagaugacccugggaauguguugcauaaucacggccaguguccuccuaugguaugcacagauacaaccacacuggauagcagccucaauaauacuggaguuuuuucucauagucuugcucauuccagaaccagaaaaacagagaacaccccaagacaaccaauugaccuacguugucauagccauccucacagugguggcugcaaccauggcaaacgagauggguuuccuggaaaaaaccaagaaagaccucggacugggaagcauuacaacccaggaaucugagagcaacauccuagacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccucgccaucggaugcuacucacaagucaacccuauaacucucacagcagcucuucuuuuauugguagcacacuaugccauuauagggccaggacuccaagcaaaagcaaccagagaagcacagaaaagagcagcagcaggcaucaugaaaaacccaacagucgauggaauaacagugauugaccuagaaccaauacccuaugauccaaaauuugaaaagcaguuaggacaaguaaugcuccuaauccuaugcgugacucaaguauuaaugaugaggacuacaugggcuuugugugaggcucuaacccuagcgaccggacccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucagaucuacaagaaaaguggaauccaggaaguagauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacugaagaauguaagagaagucaaaggccuaacaaaaggaggaccaggacacgaagaacccaucccuaugucaacauauggguggaauuuagugcgucugcaaagcggaguugacguuuucuucaccccgccagaaaaaugugauacauuguugugugacauaggggagucgucaccaaaucccacgauagaagcaggacgaacacucagaguccucaacuuaguagaaaauugguugaacaacaacacccaauuuugcauaaagguccucaacccauauaugcccucagucauagaaaaaauggaaacauuacaaaggaaguauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuaugagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauucggacaacagcgcguuuuuaaagagaaaguagacacgagaacccaagaaccgaaagaaggcacuaagaagcugaugaaaaucacggcagaguggcuuuggaaagaacuaggaaagaaaaagaccccuagaauguguaccagagaagaauucacaagaaaagugagaagcaaugcagccuugggggcuauauucacugaugagaacaaauggaaaucggcacgugaggcuguugaagaugguagguuuugggaguugguugacagggaaagaaaucuccaucuugaaggaaagugugaaacauguguguacaacaugaugggaaaaagagagaagaaacuaggagaguucggcaaggcaaaaggcagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccucaauacuuucaccaauauggaagcccaauuaauuagacagauggagggagaaggaaucuucaaaagcauucagcaccugacagccauagaagaaaucgcuguacagaacugguuagcaaaaguggggcgugaaaggcuaucaagaauggcaaucaguggagaugauuguguuguaaaacccauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauucaagaaaacccguggauggaagacaaaacuccaguggaaucaugggaagaagucccauacuugggaaaaagagaagaccaauggugcggcucauugauugggcuaacaagcagggcuaccugggcgaagaacauccagacagcaauaaaucaagucagaucccuuauaggcaaugaggaauacacagacuacaugccauccaugaagagauucagaagggaagaggaagaggcagguguccugugguag

SEQ ID NO: 6493 - RNA, 9876 nt, Artificial Sequence
  derived and/or modified CDS sequence (wt) from DENV-2__KJ189305__SS-prME
acagcaggcgugauuguuaugcugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucaccuacaaguguccucuccucagacaaaaugaaccagaagacauagauuguuggugcaacuccacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugauauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauucggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggauaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgccugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguucgagacaacaaugagaggagcaaagagaauggcuauuuuaggugacacagccugggauuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccauauucuaucagaaaaugagguaaaauugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaauacaaacagagcuuggaacucgcuggaaguugaagacuaugguuuuggaguuuuuaccaccaauauauggcuaaaauugaaagaaaaacaggauguauuuugugacucaaaacucaugucggcggcuaucaaagacaacagagccguucacgccgauauggguuauuggauagaaagugcacucaaugacacauggaagauggagaaagccuccuucauugaaguuaaaagcugccauuggccaaagucacacacccucuggagcaauggaguauuagaaagugagaugauaauuccaaaaaacuuugccgggccagcgucacaacacaacuacagaccaggcuacuauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaauaccaauuggcagugaccaucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaauuaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacaaaaccuggaauuuucaaaaccaacaccggaaccauaggcgccguaucucuggacuuuuccccuggaacgucaggaucuccaauugucgacaaaaaaggaaagguugugggucuuuacggcaaugguguugucacaaggaguggagcguauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucaaagccgaacacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaggggaagacuguuugguuuguuccaaguauaaaagcaggaaaugacauagcagcuugccuuagaaaaaauggaaagaaaguaauacaacucaguaggaagacuuuugacucugaguauguuaagacuagagccaaugauugggacuuuguggucacaacugacauuucagaaaugggugccaauuucaaggcugagaggguuauagaccccagacguugcaugaaaccaguuauacuaacagauggcgaagaacgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguugucauagccauccucacagugguggcugcaaccauggcaaacgagauggguuuccuggaaaaaaccaagaaagaccucggauugggaagcauuacaacccaggaaucugagagcaacauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauaggcccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccaucgcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacacgcugggaaaaagugaauuucagauuuacaagaaaaguggaauccaggaaguggauagaacccuagcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccugggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguagauacgagaacccaagaaccgaaggaaggcacgaagaagcugaugaaaaucacggcagaguggcuuuggaaagaacuaggaaagaaaaagacaccuaggauguguacuagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaagcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacguaggcaagaaggaagggggagcaauguacgccgaugauacagcaggaugggacacacgaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaaucagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugauagauuugcaagugcuuuaacagcucuaaaugacaugggaaaaguuaggaaagacauacaacaaugggaaccuucaagaggauggaacgauuggacacaagugccuuucuguucacaccauuuucaugaguuagucaugaaagauggucgcgugcucguagucccauguagaaaccaagaugaacugauugguagagcccgaauuucccagggagccggguggucuuugaaggagacggccuguuuggggaagucuuacgcccaaauguggacccuuauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccguacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6494 - RNA, 9876 nt, Artificial Sequence
  derived and/or modified CDS sequence (wt) from DENV-2__FJ898451__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacacagaagagagaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacacuuccaaagggccuugauuuucaucuuacugacagcugucgcuccuucaaugacaaugcgcugcauaggaauaucaaauagagacuucguagaagggguuucaggaggaagcuggguugacauaguuuuagaacauggaaguugugugacgacgauggcaaaaaacaaaccaacauuggauuuugaacugauaaaaacagaagccaaacaaccugccacccuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacauucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguucacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggaguuauggugcaggcugauagugguugcauugugagcuggaaaaauaaagaacugaaauguggcagcgggaucuucauuacagauaacgugcacacauggacagaacaauauaaguuccaaccagaauccccuucaaaacuagcuucagcuauccaaaaagcccaugaagaaggcauuuguggaauccgcucaguaacaagauuggagaaucugauguggaaacaaauaacaccagaauugaaucauauuuuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucacuggaaguugaagacuaugguuuuggaguuuuuuccaccaauauauggcuaaaauugagagaaaaacaggauguauuuugugacucaaaacucaugucagcggccauuaaagacaacagagccguccaugccgauauggguuauuggauagaaaguguacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaagauggaugcugguacgggauggaaaucagaccuuugaaagagaaagaggagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuuugugacauugaucacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauccuagaacugacugaugcguuagccuugggcaugaugguccucaaaauagugagaaauauggaaaaauaccaauuggcagugaccaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcaggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacguuacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaaaacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggacccaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaauccuugacccugaaccuaaucacagaaauggguaggcuuccaacuuucaugacucagaaggcaagaaacgcacuggacaacuuggcugugcugcauacggcugagguagguggaagggcguacaaucaugcucucagugaacugccggagacccuggagacacugcuucuacugacacuccuggcaacagucacaggaggaaucuucuuauucuuaaugagcggaaaagguauagggaagaugacucugggaauguguugcauaaucacagcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcuaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaacuccucagugaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcucuuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacugggaaaaagugaauuucagaucuacaagaaaaguggaauccaggaaguagauagaacccuagcaaaagaaggcaucaaaagaggagaaacggaccaccaugcugugucacgaggaucagcaaaacugagaugguucgucgagagaaauauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacggaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacguugucccuauggugacacagauggcaaugacagacacgacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcugccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaacgaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaaguuggcaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacgcaggugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacuacggaagacaugcuggcagucuggaacaggguguggauccaagaaaacccauggauggaagacaaaacuccaguggaaucaugggaagaagucccauaccuggggaaacgggaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6495 - RNA, 9876 nt, Artificial Sequence
  derived and/or modified CDS sequence (wt) from DENV-2__HM488257__SS-prME
acugcaggcauaauuauuaugaugauuccaacagugauggcguuccaucuaaccacacgcaacggagaaccacacaugaucgucaguagacaagagaaagggaaaagucuucuguuuaaaacagagaacggugugaacauguguacccucauggccauggaccuuggugaacugugugaagacacaaucacuuacaauuguccucuucucaggcagaaugaaccagaagacauagacuguuggugcaacuccacgucuacauggguaacuuaugggacaugcaccguuacaggagaacacagaagggaaaaaagaucaguggcacucguuccacaugugggaaugggacuggagacacgaacugaaacauggaugucaucagaaggggccuggaaacaugcacagagaauugaaacuugggucuugagacauccaggcuucaccauaauggcagcaauccuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugauauagucuuggaacauggaagcugugugacgacgauggcgaaaaauaaaccaacauuggauuuugaacugauaaaaacagaagccaaacaucccgccacucuaaggaaguauuguauagaggcaaagcugaccaacacaacaacagcaucucgcugcccaacacaaggagaaccuagccuaaaugaagaacaggacaaaagauuugucugcaaacacuccaugguagauagaggauggggaaauggaugcggauuauuuggaaagggagguaucgugaccugugcaauguucacaugcaaaaagaacauggaaggaaaaaucgugcaaccagaaaacuuggaguacaccauugugauaacaccucacucaggggaagagaaugcagucggaaaugacacaggaaaacacggcaaggaaauuaaaguaacaccacagaguuccaucacagaagcagaacuaacaggcuauggcacugucacgauggaaugcucuccgagaacgggccucgacuucaaugagaugguguugcugcaaauggaaaacaaggcuuggcuggugcacaggcaaugguucuuagaccugccauuaccauggcugcccggagcagacacacaaggaucaaauuggauacagaaggagacauuggucacuuucaaaaauccccaugcaaagaaacaggauguuguuguuuuaggaucccaagaaggggcuaugcacacagcacucacaggggccacggaaauccagaugucaucaggaaacuuacuguucacaggacaucuuaaaugcaggcugagaauggacaaacuacagcucaaaggaaugucauauuccauguguacaggaaaguucaaaguugugaaggaaauagcagaaacacaacauggaacaauaguuaucagaguacaauaugaaggagacgguucuccgugcaagaucccuuuugaaauaauggauuuggaaaaaagacaugucuuaggucgcuugauuacagucaacccaauugucacagaaaaagacagcccagucaacauagaagcagaaccuccauucggagacagcuacaucauuguaggaguagaaccgggacaacugaagcucagcugguuuaagaaaggaaguucuauuggccaaauguuugagacaacaaugagaggagcgaagagaauggccauuuuaggugauacagcuugggauuuuggaucccugggaggaguguucacaucuauaggaaaggcccuccaccaagucuuuggagcaaucuauggggcugccuucagugggguuucauggacuaugaaaauccucauaggagucgucaucacauggauaggaaugaauucacgcagcaccucacugucugugucacuaguauuagugggagucgugacauuguauuugggaguuauggugcaggccgauagugguugcguugugaguuggaaaaacaaagaacugaaauguggcagugggauuuuuaucacagacaacgugcacacauggacagaacaauacaaauuccaaccagaauccccuucaaagcuggcuucagcuauccagaaggcucaugaagagggcauuuguggaauccgcucaguaacaagacuggagaaucugauguggaaacaaauaacaccagaacugaaucacauucuaucagaaaaugagguaaaguugacuaucaugacaggagacauuaaaggaaucaugcaggcaggaaaacgaucccugcggccucaacccacugagcugaaguacucuuggaaagcauggggcaaagcgaaaaugcucuccacagagcuucauaaccacaccuuucucauugauggccccgaaacagcagaaugucccaacacaaacagagcuuggaacucacuagagguugaagacuauggcuuuggaguauucaccaccaacauauggcugaaauugaaagaaaggcaggauguauuuugugacucaaaacucaugucagcagccauaaaagacaacagagccguccacgccgauauggguuauuggauagaaagcgcacucaaugacacauggaagauugagaaagccucuuuuauugaaguuaaaagcugccacuggccaaagucacacacucucuggaguaauggagugcuagaaagugagaugauaauuccaaagaauuuugcaggaccagugucacaacacaauuacagaccaggcuaucauacacaaacggcaggacccuggcaucuaggcaggcuugagauggacuuugauuucugcgaaggaaccacagugguggugacugaggacuguggaaauagaggacccucuuuaagaacaacuacugcuucuggaaaacucauaacagaauggugcugccgaucuugcacauuaccaccgcuaagguacagaggugaggauggaugcugguauggaauggaaaucagaccauugaaagagaaagaagagaacuuggucaacucuuuggucacagccggacauggacagauugacaacuucucacuaggagucuugggaauggcauuguuccuggaagagaugcucaggacccgaguaggaacgaaacaugcaauauuacuaguugcagucucuuucgugacauugaucacagggaacauguccuuucgagauuuggggagagugauggucauggugggcgcuacuaugacggaugacauaggcaugggcgugacuuaucuugcccuauuagcagccuucaaagucagaccaacuuaugcagcuggacuacucuuaagaaaguugaccuccaaggaauuaaugaugaccaccauaggaaucguacuccucucucagagcaccauaccagagacuauacuugaacugacugacgcguuggcuuuggggaugaugguucucaaaauaguaagaaacauggaaaaguaucaacuagcagugacuaucauggcuaucuugugcgucccaaaugcagugauauuacaaaacgcauggaaagugagcugcacaacacuggcaaugguguccguuuccccacugcuuuuaacauccucacagcagaaagcggauuggauaccacuggcguugacgaucaaaggccucaauccaacagccauuuucuuaacaacccucucaaggacuagcaagaaaaggagcuggccacuaaaugaggcuauuauggcagucgggauggugagcauuuuagccaguucucucuuaaagaaugauauucccaugacaggaccauuaguggcuggagggcuucucacuguguguuacgugcucacuggaagaucggcugauuuggaacuggagagagcugcugacguaagaugggaagaacaggcagagauaucaggaagcaguccaauucugucgauaacaauaucggaagaugguagcaugucgauaaaaaaugaagaagaagaacaaacacugaccauacucauuagaacaggacugcuggugauaucaggacuuuuucccgugucaauaccaaucacggcagcugcaugguaccugugggaagugaaaaaacaacgagcuggaguauugugggaugucccuucaccuccaccugugggaaaggccgaacuggaagauggagccuauagaaucaagcagaaagggauucuaggauacucgcagaucggagccggaguuuacaaagaaggaacauuccacacaauguggcaugucacacguggugcuguucuaaugcauaaagggaagagaauugaaccaucaugggcggacgucaagaaagaccuaauaucguauggaggaggcuggaagcuagaaggagaauggaaggaaggagaagaaguccagguccuggcauuagagccuggaaagaauccaagagccguccaaacaaaacccggucuuuuuaaaacuaacacuggaaccauaggcgccguaucucuggacuuuucuccuggaacgucaggauccccaauugucgacaaaaaaggaaaaguugugggccuuuauggcaacggugucgucacaaggaguggaacauaugugagugccauagcccagacugaaaaaagcaucgaagacaauccagagauugaagaugacaucuuucgaaagaaaagauugaccaucauggaccuccacccaggagcaggaaaaacaaagagauaccuuccagcgauagucagagaagccauaaaacgaggcuugagaacacuaauccuggcccccacuagaguuguggcggcugaaauggaagaagcucucagaggacuuccaauaagauaccaaaccccagccaucagagcugagcacacuggacgggagauuguggaucuaaugugucacgccacauuuaccaugaggcugcuaucaccaauuagagugccaaauuacaaccugauuaucauggaugaagcccauuucacagacccagcaagcauagcagcuagaggauacauuucaacucgaguagagaugggugaagcagcugggauuuucaugacagcuaccccuccuggaagcagagacccauuuccucagagcaacgcaccaaucauggaugaagaaagggaaaucccugagcguucguggaacucuggacaugaguggguuacggauuuuaaagggaagacuguuugguuuguuccaaguauaaaagcaggaaaugauauagcagcuugccugagaaagaauggaaagaaagugauacaacucagcaggaagaccuuugauucugaauauaucaagacuaggaccaaugauugggacuuuguggucacgacagacauuucagaaaugggugcuaacuucaaggcugagaggguuauagaccccagacgcugcaugaaaccagucauacuaacagacggugaagagcgugugauccuggcaggacccaugccagugacccacucuagugcagcacaaagaagagggagaguaggaagaaauccgaaaaaugaaaaugaccaguacauauacaugggggaaccucuggaaaaugaugaagacugugcacacuggaaagaagcuaagaugcuucuagauaacaucaacacgccugaaggaaucauucccagcauguucgaaccagagcgugaaaagguggacgccauugauggugaauaccgcuugagaggagaagcgaggaaaacauuuguggaccuaaugagaagaggagaccuaccagucuggcuagccuacagaguggcagcugaagguaucaacuacgcagacagaagauggugcuuugauggagucaagaacaaccaaaucuuggaagaaaauguggaaguggaaauuuggacgaaagaaggagaaaggaagaaauuaaaacccagaugguuagaugcuaggaucuacucugacccacuggcgcucaaagaauucaaggaauucgcagcuggaagaaaaucccugaccuugaaucuaaucaccgagauggguaggcucccaaccuucaugacccagaaagcaaggaaugcauuggacaacuuagcaguccugcauacggcugaagcaggcggaagggcguacaaucaugcucuuagugaacugccggagacucuggagacauugcuuuuacugacacuuuuggccacagucacgggcggaaucuuccuguucuugaugagcggaaaggguauagggaagaugacccugggaaugugcugcauaaucacggccaguauucuccuaugguaugcacaaauacagccacacuggauagcagcuucaauaauacuggaguuuuuucucauagucuugcucauuccagaaccagaaaagcagagaacaccccaagauaaccaauuaacuuauguugucauagccauccuuacagugguggccgcaaccauggcaaacgagauggguuuccuggaaaaaacaaagaaagauuucggauugggaagcauuacaacccagcaaccugagagcaacauccuggacauagaucuacguccugcaucagcuuggacucuauaugccguggcaacaacuuucaucacaccaauguugagacauagcauugaaaauuccucagugaaugugucucuaacagccauugccaaccaagccacaguguuaaugggucuugggaaaggauggccauugucaaaaauggacaucggaguuccccuucucgcuaucggaugcuauucacaagucaaccccauaacucucacagcagcccuucucuuauugguagcacauuaugcuaucauagggccaggacuccaagcgaaagcaacuagagaggcucagaaaagagcagcagcgggcaucaugaaaaacccaacuguggauggaauaacagugauugaccuagauccaauacccuaugauccaaaguuugaaaagcaguugggacaaguaaugcucuuaguccucugcgugacucaaguauugaugaugaggacuacaugggcuuuaugugaagcucuaaccuuagcgaccgggcccaucucuacacugugggaaggaaacccagggagauuuuggaauacaacuauugcagugucaauggcuaacauuuuuagagggaguuaccuggccggagccggacuucucuuuucuaucaugaagaacacggcuaacacaagaaggggaacuggcaacacaggagagacgcuuggagagaaauggaaacaccgguugaaugcauuggggaagagugaauuccagaucuauaagaaaaguggaauccaggaaguggauagaaccuuagcaaaagaaggcaucaaaagaggagaaacggaccaucacgcugugucgcgaggcucggcgaaacugagaugguucgucgagagaaaccuggucacaccagaagggaaaguaguggaccuuggcugcggcagggggggcuggucauacuauugugggggacuaaagaauguaaaagaagucaaaggccuaacaaaaggaggaccaggacacgaagaacccauucccaugucaacauaugguuggaaucuggugcgucuucaaaguggaguugaugucuuuuuuacuccgccagaaaagugugacacauugcugugugacauaggggagucgucaccaaaccccacgguugaggcaggacgaacacucagaguucuaaacuuaguggaaaacuggcugaacaacaacacccaauuuugcauaaagguucucaacccauauaugccuucaguuauagaaaaaauggaagcgcuacaaaggaaauacggaggagcuuuggugaggaauccacucucacgaaauuccacacacgagauguacuggguauccaaugcuuccgggaacauagugucaucagugaacaugauuucaagaauguugauuaacagauucacaaugagacauaagaaggccacauacgagccagauguugaucucggaaguggaacccgcaacaucggaauugaaagugagacaccaaauuuagacauaauugggaaaagaauagaaaaaauaaaacaagagcaugaaacaucauggcacuaugaccaagaccacccauacaaaacgugggccuaccauggcagcuacgaaacaaaacagacuggaucagcaucauccauggugaacggagugguuaggcugcuaacaaaaccuugggacgucaucccuauggugacacagauggcaaugacagacacgacuccauuuggacaacagcgcguuuucaaagagaaaguggacacgagaacccaagaaccgaaagaaggcacgaaaaaacuaaugaaaaucacggcagaauggcucuggaaagaacuaggaaagaaaaagacaccuaggaugugcaccagggaagaauucacaagaaaggugagaagcaaugcagccuuaggugccauauucacugacgagaacaaguggaagucggcacgugaggcuguugaagacaguggauuuugggaauugguugacaaggaaaggaaucuccaucuugaaggaaagugugagacauguguguauaacaugaugggaaagagagagaagaagcuaggggaguucggcaaagcaaaaggcagcagagccauaugguacauguggcuuggagcacgcuucuuagaguuugaagcccuaggauucuugaaugaagaucacugguuuuccagaaagaacucccugaguggaguggaaggagaagggcugcacaaacuagguuacauuuuaagagacgugaguaagaaagaaggaggagcaauguacgccgaugacaccgcaggaugggacacaagaaucacacuagaggacuugaaaaaugaagaaauggugacaaaccacauggaaggagaacacaagaaacuugcugaagccauuuucagauuaacguaccaaaacaagguggugcgugugcaaagaccgacaccaagaggcacaguaauggacauuauaucgagaagagaccaaagagguaguggacaaguugucaccuacggccucaauacuuucaccaacauggaagcccaacugaucagacagauggagggagaaggagucuucaaaagcauccagcaccugacagccacagaagaaauugcagugaaaaccugguuaguaagaguggggcgugagagguuaucaagaauggccaucaguggagaugacuguguugugaaacccuuagaugacagguuugcaagcgcucuaacagcucuaaaugacaugggaaagguuaggaaagacauacaacaaugggaaccuucaagaggauggaacgauuggacacaagugcccuuuuguucacaccauuuccaugaguuaaucaugaaggacggucguguacucguaguuccauguagaaaccaagaugaacugauugguagggcucgaauuucccagggagccgggugguccuugcgggaaacagccuguuuggggaagucuuacgcccaaauguggagccugauguacuuccacagacgugaccuuaggcuggcggcaaaugccauuugcucggcagucccaucacauuggguuccaacaagucgaacaaccugguccauacacgccacacaugaguggaugacgacagaagacaugcugacagucuggaacaggguguggauucaagaaaacccauggauggaagacaaaacuccaguagaaucaugggaggaaaucccauauuuggggaaaagagaagaccaauggugcggcucauugauugggcuaacaagcagagccaccugggcaaagaacauccaaacagcaauaaaucaaguuagaucccuaauaggcaaugaggaauacacagacuacaugccauccaugaaaagauucagaagagaagaggaagaggcaggggucuugugguag

SEQ ID NO: 6496 - RNA, 9876 nt, Artificial Sequence
  derived and/or modified CDS sequence (wt) from DENV-2__HQ999999__SS-prME
acagcaggcgugauuguuauguugauuccaacggcgauggcguuccauuugaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauauucagagaauugaaaccuggaucuugagacauccagguuuuaccauaauggcagcaaucuuggcauacacuauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccagccacucuaaggaaguacuguauagaagcaaagcugaccaacacaacaacagaaucacguuguccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaauauggaaggaaaagucgugcagccagaaaacuuggaauacaccaucgugauaacaccccacucaggagaagagcacgcuguagguaaugacacaggaaagcauggcaaagaaaucaagauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaacuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccaaucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauucuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccauauucuaucagaaaaugagguaaaguugaccauuaugacaggagacauuaaaggaaucaugcaggcaggaaaacgaucuuugcggccccagcccacugagcugaaguauucauggaaaacaugggggaaggcgaaaaugcucuccacagagucucacaaucagaccuuucuuauugauggcccugaaacagcagaaugccccaacacaaacagagcuuggaacucacuggaaguugaagacuaugguuuuggaguuuucaccaccaauauauggcugaaauugaaagaaaaacaggauguauuuugugacucaaaacucaugucagcggccauuaaagacaacagagccguucaugccgauauggguuauuggauagaaagcgcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggauuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagaaaaagaggagaauuuggucaacuccuuggucacagccggacaugggcagauugacaacuuuucauuaggaguccugggaauggcacuguuccuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaacugaugauggccaccauaggaaucgcacuccuuucccaaagcaccauaccagagaccauucuugaacugacugaugcauuagccuugggcaugaugguccucaaaguggugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcacgaaaaggagcuggccgcuaaaugaagcuaucauggcagucgggauggugagcauuuuagccaguucucuccuaaagaaugacauuccuaugacagguccauuaguggcuggagggcuccuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgagcuggaggauggagccuacagaaucaagcaaagagggauucuuggauauucucagauaggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuucccccggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagcugggauuuucaugacagccacuccuccgggaaguagagacccauuuccucagagcaacgcaccgaucauggaugaggaaagagaaaucccugagcguucguggaauucaggacacgaaugggucacggauuuuaaggggaagacuguuugguuuguuccaaguauaaaagcaggaaaugauauagcagccugucuuaggaaaaauggaaagaaagugauacaacucaguaggaagacuuuugacucugaguauguuaagacuagagccaaugauugggacuuuguggucacaacugacaucucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaacuacgcagacagaaggugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcacacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacagcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuucucacaccaauguugagacauagcauugaaaauuccucagugaaugucucccuaacagccauugcuaaccaagcuacagugcuaaugggucuugggaaaggauggccauugucaaagauggacauuggagcuccccuccuugccauuggaugcuauucacaagucaacccuauaacucucacagcagcucuucuucuauugguagcacauuaugccauuauagggccagggcuucaagcaaaagcaaccagagaagcucagaaaagagcagcagcaggcaucaugaaaaacccaacagucgauggaauaacagugauugaccuagacccaauacccuaugauccaaaauuugaaaagcagcuaggacaagugaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugccgugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacucagaguccucaacuuaguggaaaauugguuaaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaucuaggaaguggaacccguaacaucggaauugaaagugagguaccaaaucuagacauaauaggaaagagaauagagaaaauaaaacaagagcaugaaacaucauggcacuaugaucaagaccacccauacaaaacgugggcuuaccauggcaguuaugaaacaaaacaaacuggaucagcaucaucuauggugaacggaguggucagauugcugacaaaaccuugggacgucgucccuauggugacacagauggcgaugacagacacgacuccauuuggacaacagcgcguuuucaaagagaaaguagacacgagaacccaagaaccgaaggaaggcacaaagaaacugaugaaaauuacagcagaguggcuuuggaaagaacuaggaaagaaaaaaacacccaggauguguaccagagaagaauucacaagaaaagugagaagcaacgcagccuugggggccauauucacugaugagaacaaauggaaaucggcacgugaggcuguugaagauggcagguuuugggagcugguugacagggaaagaaaucuccaucuugaaggaaagugugaaacauguguguauaacaugaugggaaaaagagagaagaaacugggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagaagugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaauaagguggugcgugugcaaagaccaacaccaagaggcacaguaauggacaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuacuugggcaaagaauauccaaacagcaauaaaucaagucagaucccuuauaggcaaugaggaauacacagacuacaugccauccaugaagagauucagaagggaagaggaagaggcagguguccugugguag

SEQ ID NO: 6497 - RNA, 9876 nt, Artificial Sequence
  derived and/or modified CDS sequence (wt) from DENV-2__FJ898449__SS-prME
acugcaggcaugaucaucaugcugauuccaacagugauggcguuucaucugaccacacgcaacggagaaccacacaugaucgucaguaggcaagaaaaagggaaaagccuucuguuuaagacaaaggauggcacgaacauguguacucucauggccauggaccuuggugaguugugugaagacacaaucacguauaaauguccuuuucucaagcagaacgaaccagaagacauagauuguuggugcaacuccacguccacauggguaacuuacgggacauguaccacuacaggagagcacagaagagaaaaaagaucaguggcgcuuguuccacacgugggaaugggauuggagacacgaacugaaacauggaugucaucagaaggggccuggaaacaugcccagagaauugaaacuuggauucugagacauccaggcuuuaccauaauggccgcaauccuggcauacaccauaggaacgacgcauuuccaaagaguccugauauucauccuacugacagccaucgcuccuucaaugacaaugcgcugcauaggaauaucaaauagggacuuuguggaaggagugucaggaggaaguuggguugacauaguuuuagaacauggaaguugugugacgacgauggcaaaaaauaaaccaacacuggacuuugaacugauaaaaacagaagccaaacaacccgccaccuuaaggaaguacuguauagaggcuaaacugaccaacacgacaacagacucgcgcugcccaacacaaggggaacccacccugaaugaagagcaggacaaaagguuuguuugcaaacauuccaugguagacagaggauggggaaauggauguggauuguuuggaaaaggaggcaucgugaccugugcuauguucacaugcaaaaagaacauggaaggaaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguuacgauggagugcucuccaagaacgggucucgacuucaaugagaugguguugcugcaaauggaagacaaagcuuggcuggugcacagacaaugguuccuagaccuaccguugccauggcugcccggagcagacacacaaggaucaaauuggauacagaaagagacauuggucaccuucaaaaauccccaugcgaaaaaacaggauguuguugucuuaggaucccaagaaggggccaugcauacagcacucacaggggcuacggaaauccagaugucaucaggaaaccugcuguucacaggacaucucaaaugcaggcugaggauggacaaauuacaacuuaaagggaugucauacuccaugugcacaggaaaguuuaaaauugugaaggaaauagcagaaacacaacauggaacaauagucauuagaguacaauaugaaggagacggcucuccaugcaagauccccuuugagauaauggaucuggaaaaaagacauguuuugggccgucugaucacagucaacccaauuguaacagaaaaggacaguccagucaacauagaagcagaaccuccauucggagacagcuacaucaucauaggaguggaaccaggacaauugaagcuggacugguucaagaaaggaaguuccaucggccaaauguuugagacaacaaugaggggagcgaaaagaauggccaucuugggcgacacagccugggauuuuggaucucugggaggaguguucacaucaauaggaaaagcucuccaccagguuuucggagcaaucuacggggcugcuuucaguggggucucauggacuaugaagauccuuauaggaguuaucaucacauggauaggaaugaacucacguagcacaucacugucugugucacugguauuagugggaaucgugacacuguacuugggaguuauggugcaagccgauagugguugcguugugagcuggaagaacaaagaacuaaaauguggcaguggaauauucgucacagauaacgugcauacauggacagaacaauacaaguuccaaccagaauccccuucaaaacuggcuucagccauccagaaagcucacgaagaaggcauuuguggaauccgcucaguaacaagacuagaaaaucuuauguggaaacagauaacaucagaauugaaucauauucuaucagaaaaugaagugaaacugaccaucaugacaggagacaucaaaggaauuaugcaggugggaaaacgaucccugcggccucaacccacugaguugagguauucauggaaaacauggggcaaagcgaaaaugcucuccacagaacuccacaaucagaccuuccucauugauggucccgaaacagcagaaugccccaacacaaacagagcuuggaauucacuagaaguugaggacuauggcuuuggaguauucacuaccaauauauggcuaagauugagagaaaagcaggauguauuuugugacucaaaacuuaugucagcggccauaaaggacaacagagccguccaugcugauauggguuauuggauagaaagcgcacucaaugauacauggaagauagagaaagcuucuuucauugaagucaaaaguugccacuggccaaagucacacacucuauggaguaauggagugcuggaaagcgagaugauaauuccaaagaauuucgcuggaccagugucacaacacaauaacagaccaggcuaucacacacaaacagcaggaccuuggcaucuaggcaagcuugagauggacuuugauuucugcgaagggaccacaguggugguaaccgaggaauguggaaacagagggccuucuuuaagaacaaccacugccucaggaaaacucauaacggaaugguguugucgaucuugcacacuaccaccacuaagauacagaggugaggauggaugcugguacgggauggaaaucagaccauugaaagagaaagaagaaaaucuggucaguucucuggucacagccggacaugggcagauugacaauuucucauuaggaauuuugggaauggcacuguuccuugaagaaaugcucaggacucgaguaggaacgaaacaugcaauacuacuagucgcaguuucuuucguaacguuaaucacagggaacaugucuuuuagagaccugggaagagugaugguuauggugggugccaccaugacagaugacauagguaugggugugacuuaucuugcucuacuagcggccuucaaagucagaccaaccuuugcagcuggacugcucuugagaaaacugaccuccaaggaauuaaugaugaccaccauaggaaucguucuucucucucagaguagcauaccagagaccauucuugagcugaccgaugcguuagcuuuaggcaugaugguccucaagauggugagaaacauggaaaaauaucagcuggcagugacuaucauggcuauucugugugucccaaaugcugugauauuacagaacgcauggaaagugaguugcacaauacuggcaguggugucuguuuccccccugcucuugacauccucacaacagaaagcggacuggauaccauuagcguugacgaucaaaggccucaacccaacagccauuuuucuaacaacccucucaagaacuagcaagaaaaggagcuggccuuuaaacgaggccaucauggcgguugggauggugaguaucuuggccagcucucucuugaagaacgacauccccaugacaggaccauuaguggcuggagggcuucuuacugugugcuacguauuaacugggcggucagccgaucuggaacuagagagagcuaccgaugucaaaugggaugaccaggcagagauaucagguagcaguccaauucugucaauaacaauaucagaagauggcagcaugucgauaaagaaugaagaggaagagcaaacacugacuauacucauuagaacaggauugcuugugaucucaggacucuuuccgguaucaauaccaauuacagcagcagcaugguaccugugggaaguaaagaaacaacgggcuggaguguugugggauguccccucaccaccacccgugggaaaggcugaauuggaagauggagccuacagaaucaagcaaaaaggaauccuaggauauucccagaucggagcuggaguuuacaaagaaggaacauuucacaccauguggcacgucacacguggcgcuguccuaaugcauaaggggaagaggauugaaccgucaugggcggacgucaagaaagacuuaauaucauauggaggagguuggaaacuagaaggagaauggaaagaaggagaagaaguccaggucuuggcauuggagccugggaaaaauccaagagccguccaaacaaaaccuggccuuuuuagaaccaauacuggaaccauaggugccguaucccuggacuuuuccccugggacgucaggaucuccaaucguugacaaaaaaggaaaaguuguaggccucuauggcaauggugucguuacaaggaguggagcauaugugagugccauagcucagacugaaaaaagcauugaagacaauccagagauugaagaugacaucuuucgaaagagaagauugacuaucauggaucuccacccaggagcaggaaagacaaagaaauaccucccggccauagucagagaggccauaaaaagaggcuugagaacacuaauccuagcccccacuagagucguggcagcugaaauggaggaagcccuuagaggacuuccaauaagauaccaaacuccagccaucagggcugagcacaccgggcgggaaaucguggacuuaaugugucaugccacauuuaccaugaggcugcuaucaccaaucagggugccaaauuacaaccugaucaucauggaugaagcccauuuuacagauccagcaagcauagcagcuaggggauacaucucaacucgaguggagaugggugaggcagcuggaauuuuuaugacagccacuccuccggguagcagagauccauuuccucagaguaaugcaccaauuauggacgaagaaagagaaauuccggaacguucauggaacuccgggcacgagugggucacggauuuuaaaggaaagacugucugguuuguuccaagcauaaaaaccggaaaugacauagcagccugccugagaaagaauggaaagagggugauacaacucaguaggaagaccuuugauucugaauacgucaagacuagaaccaaugacugggauuucgugguuacaacugacauuucggaaaugggugccaacuuuaaagcugagaggguuauagaccccagacgcugcaugaaaccaguuauacuaacagacggcgaagagcgggugauucuggcaggacccaugccagugacccacuccagugcagcacaaagaagagggagaauaggaaggaauccaaggaaugaaaaugaucaauacauauauaugggagaaccccuggaaaaugaugaagacugugcgcauuggaaggaagcuaagaugcuccuagauaacaucaacacaccugaaggaaucauucccagcauguucgagccagagcgugaaaagguggaugccauugacggugaauaucgcuugagaggagaagcacggaaaacuuuuguggaccuaaugagaagaggagaccuaccagucugguuggcuuauaaaguggcaucugaagguaucaacuacgcagacagaagaugguguuuugacggaaccagaaacaaucaaauuuuggaagaaaauguggaaguggaaaucuggacaaaggaaggggaaaggaaaaaauugaaaccuagaugguuagaugcuaggaucuacuccgacccacuggcgcuaaaagaauucaaggaauucgcagccggaagaaagucccuaacccugaaccuaaucacagagaugggcagacucccaacuuuuaugacucagaaggccagagaugcacuagacaacuuggcggugcugcacacggcugaagcggguggaaaggcauacaaucaugcucucagugaacuaccggagacccuggagacauugcuuuugcugacacuguuggccacagucacgggaggaaucuuucuauuccugaugagcggaagggguauagggaagaugacccugggaaugugcugcauaaucacggccagcauccucuuaugguaugcacaaauacaaccacauuggauagcagcuucaauaauauuggaguucuuucucauagucuugcucauuccagaaccagaaaagcagaggacaccccaggauaaucaauugacuuaugucaucauagccauccuuacagugguggccgcaaccauggcaaacgaaauggguuuucuagaaaaaacaaagaaagaccucggacugggacacauugcaacccagcaaccugagagcaacauucuggacauagaccuacguccugcaucagcauggacguuguaugccguggcuacaacauuuaucacaccaauguugagacauagcauugaaaauuccucaguaaauguaucccuaacagccauagcuaaccaagccacagugcuaaugggucucgggaaaggauggccauugucaaagauggacauuggaguuccccuccuugccauuggguguuacucacaagucaacccuauaacccucacagcggcucuucuuuuauugguagcacauuaugccaucauaggaccgggacuucaagccaaagcaaccagagaagcucagaaaagagcagcggcgggcaucaugaaaaacccaacuguggauggaauaacagugauagaucuagauccaauacccuaugauccaaaguuugaaaagcaguugggacaaguaaugcuccuaguccuuugugugacccaagugcugaugaugaggacuacgugggcuuugugugaagccuuaacucuagcaaccggacccguguccacauugugggaaggaaauccagggagauucuggaacacaaccauugcagugucaauggcaaacaucuuuagagggaguuaccuugcuggagcuggacuucucuuuucuaucaugaagaacacaacuagcacgagaagaggaacuggcaacauaggagaaacgcuaggagagaaguggaaaagcagacugaacgcauuggggaaaagugaauuccagaucuacaaaaaaaguggaauucaagaaguggacagaaccuuagcaaaagaaggcauuaaaagaggagaaacggaucaucacgcugugucgcgaggcucagcaaaacugagaugguucguugaaagaaauuuggucacaccagaagggaaaguaguggaccucgguugcggcagagggggcuggucauacuauuguggaggauugaagaauguaagagaaguuaaaggcuuaacaaaaggaggaccaggacacgaagaaccuaucccuaugucaacauauggguggaaucuaguacgcuuacagagcggaguugacguuuuuuuuguuccaccagagaggugugacacauuguugugugacauaggggaaucaucaccaaaucccacaguagaagcgggacgaacacuuagaguccucaaccuaguggaaaauuggcugaacaauaacacccaauuuugcguaaaaguucuuaacccguacaugcccucagucauugaaagaauggaaaccuuacaacggaaauacggaggagccuuggugagaaauccacucucacggaauuccacacaugaaauguacuggguguccaaugccuccgggaacauagugucaucagugaacaugauuucaagaaugcugauuaacagauucaccaugagacacaagaaggccaccuaugagccagaugucgaccucggaagcggaacccgcaacauuggaauugaaagugagacaccgaaccuagacauaauuggaaaaagaauagaaaaaauaaaacaagagcaugaagcgucauggcacuaugaccaagaccacccauacaaaacaugggcuuaccauggcagcuaugaaacaaaacagacuggaucagcaucauccauggugaacggaguagucagauugcugacaaaacccugggacguuguuccaauggugacacagauggcaaugacagacacaacuccuuucggacaacagcgcgucuucaaagagaagguggacacgagaacccaagaaccaaaagaaggcacaaaaaaacuaaugaaaaucacggcagaguggcucuggaaagaacuaggaaaggaaaagacaccuagaaugugcaccagagaagaauuuacaaaaaaggugagaagcaaugcagccuugggggccauauuuaccgaugagaacaaguggaaaucggcgcgugaggcuguugaagauaauagguuuugggagcugguugacaaggaaagaaaccuccaucuugaaggaaaaugugaaacauguguauacaacaugaugggaaaaagagagaaaaaacuaggagaguuugguaaagcaaaaggcagcagagccauaugguacauguggcucggagcacgcuucuuagaguuugaagccuuaggauuuuugaaugaagaccauugguucuccagagagaacucccugaguggaguggaaggagaagggcugcauaaacuagguuacauccuaagagaggugagcaagaaagaaggaggagcaauguaugccgaugacaccgcaggcugggacacaagaaucacaauagaggauuuaaaaaaugaagaaaugauaacgaaccacauggcaggagaacacaagaaacuugccgaggccauuuuuaaauugacguaccaaaacaagguggugcgugugcaaagaccaacaccaagaggcacgguaauggacaucauaucgagaagagaccaaagggguaguggacaaguuggcaccuauggccucaacacuuucaccaacauggaagcacaacuaauuaggcaaauggagggggaaggaaucuucaaaagcauccagcacuugacagccucagaagaaaucgcugugcaagauuggcuaguaagaguagggcgugaaagguugucaagaauggccaucaguggagaugauuguguugugaaaccuuuagaugauagauuugcaagagcuuuaacagcucuaaaugacaugggaaagguuaggaaggacauacagcaaugggagcccucaagaggauggaacgacuggacacaggugcccuucuguucacaccauuuucacgaguuaauuaugaaagauggucgcacacucgugguuccaugcagaaaccaagaugaauugaucggcagagcccgaauuucccagggagcuggguggucuuuacgggagacggccuguuuggggaagucuuacgcccaaauguggaguuugauguacuuccacagacgugaucucaggcuagcggcaaaugccaucugcucggcagucccgucacacuggguuccaacaagccggacaaccugguccauacacgccagccaugaauggaugacgacggaagacauguugacaguuuggaacagaguguggauccuagaaaauccauggauggaagacaaaaccccaguggaaucaugggaggaaaucccauaccugggaaaaagagaagaccaauggugcggcucgcugaucgggcugacaagcagagccaccugggcgaagaauauccagacagcaauaaaccaagucagaucccucauuggcaaugaggaauacacagauuacaugccauccaugaaaagauucagaagagaagaggaagaggcagggguuuugugguag

SEQ ID NO: 6498 - RNA, 9876 nt, Artificial Sequence
  derived and/or modified CDS sequence (wt) from DENV-2__FJ906966__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacauguguacccucauggccauggaccuuggugaauugugugaagauacaaucacguacaaguguccuuuucucaagcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagauucucgcugcccaacacaaggagaacccagccuaaaugaagagcaggacaaaagguucgucugcaaacacuccaugguggacagaggauggggaaauggauguggacuauuuggaaaaggaggcauugugaccugugcuauguucacaugcaaaaagaacauggaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggauuaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaaugauugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggauuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcagccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaauggaguguuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacauuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagacaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6499 - RNA, 9876 nt, Artificial Sequence
  derived and/or modified CDS sequence (wt) from DENV-2__FJ906968__SS-prME
acugcaggcaugaucauuaugcugauuccaacggugauggcguuccauuuaaccacacguaacggagaaccacacaugaucgucaguagacaagagaaagggaaaagucuucuguuuaaaacagaggauggugugaacauguguacccucauggccauggaccuuggugaauugugugaagauacaaucacguacaaguguccuuuucucaagcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagauucucgcugcccaacacaaggagaacccagccuaaaugaagagcaggacaaaagguucgucugcaaacacuccaugguggacagaggauggggaaauggauguggacuauuuggaaaaggaggcauugugaccugugcuauguucacaugcaaaaagaacaugaaaggaaaagucgugcaaccagaaaacuuggaauacaccauugugauaacaccucacucaggggaagagcaugcaguaggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaaugauugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggauuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcagccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaaugaaguguuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaauacugaccauacucauuagaacaggauugcuggugaucucaggacuuuuuccuguaucaauaccaaucacggcagcagcauggugccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucuuauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagaaggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6500 - RNA, 9876 nt, Artificial Sequence
  derived and/or modified CDS sequence (wt) from DENV-2__FJ906969__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacauguguacccucauggccauggaccuuggugaauugugugaagauacaaucacguacaaguguccuuuucucaagcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagauucucgcugcccaacacaaggagaacccagccuaaaugaagagcaggacaaaagguucgucugcaaacacuccaugguggacagaggauggggaaauggauguggacuauuuggaaaaggaggcauugugaccugugcuauguucacaugcaaaaagaacaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccuaccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaauguuugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggauuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcagccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaauggaguguuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaauacugaccauacucauuagaacaggauugcuggugaucucaggacuuuuuccuguaucaauaccaaucacggcagcagcauggugccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6501 - RNA, 9876 nt, Artificial Sequence
  derived and/or modified CDS sequence (wt) from DENV-2__FJ898454__SS-prME
acugcaggcgugaucaucaugcugauuccaacagcgauggcguuccauuuaaccacacgcaacggagaaccacacaugaucgucagcagacaagagaaagggaaaagucuccuguuuaaaacagaagauggugugaacauguguacccucauggccauggaccuuggugaacugugugaagacacaaucacuuacaacuguccucuucucaggcagaaugaaccagaagacauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaaaggaggcaucgugaccugugcuauguucacaugcaaaaaaaacauggaaggaaaaauugugcagccagaaaaccuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccuugacuucaaugagaugguguugcugcaaauggaaaauaaggcuuggcuggugcacaggcaaugguucuuagaccugccguuaccaugguugcccggagcggacacacaaggaucaaauuggauacagaaggagacguuggucaccuucaaaaauccccaugcaaagaaacaggauguuguuguucuaggaucccaagaaggggcuaugcauacagcacuuacaggggccacggaaauccagaugucgucaggaaaccuacuguucacaggacaucucaagugcaggcugagaauggacaaauuacagcucaaaggaaugucauacucuauguguacaggaaaguuuaaaguuguaaaggaaauagcagaaacacaacauggaacaauaguugucagaguacaauaugaaggggauggcucuccauguaaaaucccuuuugaaauaauggauuuggaaaaaagacaugucuuaggucgccugauuacagucaacccaauugucacagaaaaagacaguccagucaacauagaagcagaaccuccauucggagacagcuacaucauuauaggaguagaaccgggacaacugaagcucagcugguuuaagaaagguagcucaaucggccaaauguucgagacaacaaugagaggagcgaagagaauggccauuuuaggugacacagccugggauuuuggaucccugggaggaguguucacaucuauaggaaaggcccuccaccaagucuuuggagcaaucuauggggcugccuucaguggggucucauggacuaugaaaauccucauaggaguugucaucacauggauaggaaugaauucacguagcaccucacugucugugucacuaguauuagugggagucgugacauuguauuugggaguuauggugcaggcugauagugguuguguugugaguuggaaaaacaaagaacugaaauguggcagugggauuuuuaucacagacaauguacacacauggacagaacaauacaaauuccaaccagaaucccccucaaagcuggcuucagcuauccagaaagcuuaugaagaggguauuuguggaauccgcucaguaacaagacuggagaaucuaauguggaaacaaauaacaccagaacugaaucacauucuaucagaaaaugaggcaaaguugacuaucaugacaggagacaucaaaggaaucaugcaggcaggaaaacgaucccugcggccucagcccacugagcugaaguauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugauucaaaacucaugucagcggccauaaaaaacaacagagccguccaugccgauauggguuauuggauagaaagcgcacuuaaugacacauggaagauagaaaaagcuucuuuuaucgaaguuaaaaguugccacuggccaaaaucacacacucucuggaguaauggagugcuagaaagugaaaugauaauuccaaaaaauuuugcuggaccaguaucacaacacaauuacagaccaggcuaucacacacaaacggcaggacccuggcaucuaggcaagcuugagauggacuuugauuuuugcgaaggaaccacagugguggugacugaagacuguggaaauagaggacccucucuaagaacaacuaccgcuucuggaaaacucauaacagaauggugcugccgauccugcacauuaccaccacuaagauacagaggugaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacuaguugcaguuucuuucaugacauugaucacagggaacaugucuuuccgagaccuagggagagugaugguuauggugggggcugcuauaacggaugacauagguaugggcgugacuuaucuugccuuacuagcagccuucaaagucagaccaacuuuugcagcuggacugcuuuugagaaagcugaccuccaaggaauugaugaugaccaccauaggaaucguacuccucucccagagcaccauaccagagacuauacuugaauugacugaugcguuggccuugggcaugaugauucucaagauagugagaaauauggaaaaguaucaauuagcagugacuaucauggcuaccuuauguguuccaaaugcagugauauuacaaaaugcauggaaagugagcugcacaauacuggcagugguguccguguccccacugcucuuaacaucuucacagcagaaagcggauuggauaccacuggcauugacgaucaaaggucucaauccaacagcuauuuuccuaacaacucucucaagaacuaacaagaaaaggaguuggccacuaaaugaggcuaucauggcagucgggauggugagcauuuuagccaguucucucuugaagaaugacauucccaugacaggaccauuaguggcuggagggcuucucacugugugcuacgugcucacuggaagaucggccgacuuggaacuggagagagccgccgacguaagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuucccguaucaauaccaaucacggcagcagcaugguaccugugggaagugaagaaacaacgggcuggaguauugugggauguuccuucacccccaccugugggaaaggccgaacuggaagauggagccuauagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguucaaacaaaacccggucuuuuuaaaacuaacaccggaaccauaggcgccgugucucuagacuuuucuccuggaacgucaggaucuccaauugucgacaaaaaaggaaaagucgugggucucuauggcaaugguguugucacaaggaguggaacauaugugagugccauagcccagacugaaaaaagcauugaagacaauccagagauugaagaugauaucuuucggaaaaaaagauugaccauuauggaccuccacccaggagcgggaaagacgaaaagauaccuuccagcaauagucagagaggcuauaaaacgaggcuuaagaacauuaauccuggcccccacuagagucguggcagcugaaauggaagaagcucuuagaggacuuccgauaagauaccaaaccccagccauuagggcugagcacacugggcgagaaaucguggauuuaaugugucaugccacauuuaccaugagguuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacuccuccgggaagcagagacccauuuccucaaagcaaugcaccaaucauggaugaagaaagggaaauccccgaacgcucguggaacucuggacaugaguggguuacagauuuuaaagggaagacugucugguuuguuccgaguauaaaagcaggaaaugauauagcagcuugccugagaaaaaauggaaagaaagugauacaacucagcaggaagaccuuugauucugaauacaucaagacuaggaccaaugauugggacuuuguggucacgacugacauuucagaaaugggugcuaacuucaaggcugaaaggguuauagaccccaggcgcugcaugaaaccagucauacuaacagacggugaagaacgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagcuaagaugcuuuuagacaacaucaacacgccugaaggaaucauucccagcauguucgaaccagagcgugaaaagguggaugccauugauggugaauaccgcuuaagaggagaagcgaggaaaaccuuuguggaccuaaugagaagaggagaccuaccagucuggcuggccuacagaguggcagccgaaggcauuaacuaugcagauagaaggugguguuuugauggaaucaagaacaaccaaaucuuggaagaaaauguggaaguggaaaucuggacaaaagagggggaaaggaagaaacugaaacccagaugguuagaugcuaggaucuacucugacccacuggcgcucaaagaauucaaagaguucgcagcuggaagaaaaucccugacccugaauuuaaucacagaaaugggcaggcuuccaacuuuuaugacucaaaaagcaaggaacgcacuggacaacuuagcaguccugcauacggcugaagcaggcggaagggcguacaaucaugcucucagugaacugccagagacccuggagacauugcuuuugcugacacuuuuggccacagucacgggcggaaucuuuuuauucuugaugaguggaaaagguauagggaaaaugaccuugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguuguuauagccauccucacagugguggccgcaaccauggcaaacgagaugggguuccuggaaaaaacgaagagagauuucggauuaggaagcauugcaacccaacaacccgagagcaacaucuuggacauagauuuacguccugcaucagcauggacccuguaugcaguggccacaacauuuaucacaccaauguugagacauagcauugaaaauuccucagugaaugugucucuaacagccauugccaaucaagccacagugcuaaugggucuugggaagggauggccauugucaaaaauggacauuggaguuccccuucucgccaucgggugcuauucacaagucaaucccauaacccucacagcagcccuucuuuuauugguagcacauuaugcuaucauagggccagggcuccaagcgaaagcaaccagagaagcccagaaaagagcagcggcaggcaucaugaaaaacccaacuguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaacuuuagcgaccgggcccaucuccacauugugggaaggaaauccagggagauuuuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagaucuacaagagaagcggaauccaggaaguggauagaaccuuggcaaaagaaggcauuaaaagaggagaaacggaccaucacgcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccgccagaaaagugugacacauuguugugugacauaggggagucgucaccaaaucccacgguugaagcaggacgaacacucagaguccuaaauuugguagaaaauuggcugaacaacaacacccaauuuugcauaaagguucuuaacccauacaugcccucagucauagaaaaaauggaaacgcugcaaaggaaauacggaggagcuuuggugaggaauccacucucaagaaauuccacacaugagauguauuggguauccaaugcuuccgggaacauagugucaucagugaacaugauuucaaggauguugauuaauagauuuacaaugagacauaagaaggccacauacgagccagauguugaccucggaagcggaacccgcaacaucggaauugaaagugagacaccaaaccuagacauaauugggaaaagaauagaaaaaauaaaacaagagcaugagacaucauggcacuaugaccaagaccacccauauaaaacaugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaagacaccuagaaugugcacuagagaagaauucacaagaaaggugagaagcaaugcagcccuaggugccauauucacugaugagaacaaguggaagucggcacgugaggcuguugaagacaguagauucugggaacugguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuccugaaugaagaucacugguuuuccagagagaacucucugagcggaguggaaggagaagggcugcacaagcuggguuacauucuaagagaagugagcaagaaagaaggaggagcaauguacgcugacgacacagcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagacccacaccaagaggcacaguaauggauauuauaucgagaagggaccaaagagguaguggacaaguuggcaccuauggccucaacaccuuuaccaauaugggagcccaacuaaucagacagauggagggagaaggagucuuuaaaggcauccagcaucugacagccacagaagaaguugcagugcaagacugguuagcaagaguggggcgugagagguuaucaagaauggccaucaguggagaugacuguguugugaaacccuuagaugacagguuugcaagcgcuuuaacagcucuaaaugacaugggaaagauuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcggcaaacgcuauuugcucggcagucccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuagggaaaagagaagaccaauggugcggcucauugauaggguuaacaagcagggccaccugggcaaagaacauccaaacagcaauaaaccaaguuagauccuuaauaggcagugaggaauacacagacuauaugccauccaugaaaagauucagaagggaagaggaagaggcaggggucuugugguag

SEQ ID NO: 6502 - RNA, 9876 nt, Artificial Sequence
  derived and/or modified CDS sequence (wt) from DENV-2__JQ922551__SS-prME
acuguaggcaugaucaucaugcugauuccaacagccauggcguuccauuuaaccacacgcaacggagaaccacacaugaucgucagcagacaagagaaagggaaaagucucuuguucaaaacagaggauggugugaacauguguacccucauggccauggaccuuggugaacugugugaagacacaaucacuuauaacuguccucuucucaagcagaaugaaccggaagauauagauuguuggugcaacuccacguccacauggguaacuuaugggacaugcacugccacaggagaacacagaagggaaaaaagaucaguggcacuugucccacaugugggaaugggauuggagacacgaacugaaacauggaugucaucagaaggggccugcaaacacgcccagagaauugaaaccuggaucuuaagacauccaagcuuuaccauaauggcagcaaucuuggcauacaccauaggaacgacauauuuccaaagaguuguguuuuugaugguacugacagcaguggcucuuucaaugacaaugcguuguauaggaauaucaaauagagacuuuguggaaggggucucaggaggaagcuggguugacauaguccuagaacauggaagcugcgugacaacgauggcaaaaaacaaaccaacauuggacuuugaacugauaaaaacagaagccaagcaaccugccacucuaaggaaguacuguauagaggcaaagcugaccaacacgacaacagcaucucgaugcccaacacaaggggaacccagccugaaugaagagcaggacaaaagguucguccgcaaacauuccaugguagacagaggauggggaaauggauguggauuauuuggaaaaggaggcauugugaccugugcuauguucacaugcaaaaaaaacauggaaggaaaaaucgugcaaccagaaaaccuggaauacacccuugugauaacaccucacucaggggaagagaaugcaguuggaaaugacacaggaaaccauggcaaggaaaucaaaguaacaccacagaguuccauuacggaagcagcacugacaggcuauggcacugucacaauggaaugcucucccagaacgggccucaacuuccaugagauggugucgcugccaauggaaaacaaagcuuggauggugcacaggcaaugguuccuagaccuaccgcugccauggcugcccggagcagacacacaaggaucaaauuggauacagaaagagacauuggucacuuucaaaaauccccaugcgaaaaaacaggacguuguugucuuaggaucccaagagggggccaugcauacagcacucacaggggcuacggaaauccagaugucaucaggaaacuugcuguucacaggacaucucaagugcaggcugagaauggacaaauuacagcuuaaagggaugucauacuccaugugcacaggaaaguuuaaaguuguguggggaauagcaagaacacaacauggaacaauaguucauagaguacaauaugaaggagacgguucuccaugcaaaaucccuuugaauauaaugggucuggaaaaaagacaugucuuaggucggccgauuacagucaacccaauugucacaggaaaagacagcccagucaacauagaagcagaaccuccauugggggacagcuacaucauuauaggaguggaaccgggacaagugaagcucaccugcucccagaagggaagcucaaucggccaaauguucgagacaacaaugagaggagcgaagagaauggccauuuuaggugacacagccugggauuuuggaucccugggaggaguguucacauccauaggaaaggcccuccaccaaguuuuuggagcaaucuauggggcugccuucaguggggucucauggacuaugaaaauccucauaggaguugucaucacauggauaggaaugaauucacguagcaccucacugucugugucauuaguacuagugggagucgugacauuguauuugggaguuauggugcaggcugauagugguuguguugugaguuggaaaaacaaagaacugaaauguggcagugggauuuuugucacagacaauguacacacauggacagaacaauacaaauuccaaccagaaucccccucaaagcuggcuucagcuauccagaaagcucaugaagagggcaucuguggaauccgcucaguaacaagacuggagaaucuaauguggaaacaaauaacaccagaacugaaucacauucuaucagaaaaugagguaaaguugacuaucaugacaggagacaucaaaggaaucaugcaggcaggaaaacgaucccugcggccucagcccacugaguugaaguauucauggaaaacauggggcaaagcgaaaaugcucuccacagaaccucauaaccagaccuuucucauugauggccccgaaacagcagaaugucccagcacaaacagagcuuggaacucacuaaaagguggagacuauggcuuugggguauucaccaccaacauauggcugaaguugaaagaaaggcaggaugugucuugugacucaaaacucaugucagcggccauaaaagacaacagagccguccaugccgauauggguuauuggauagaaagcgcacuuaaugacacauggaagauagaaaaagccucuuuuaucgaaguuaaaaguugccauuggccaaaaucacauacucucuggaguaauggagugcuagaaagugagaugauaauuccaaagaauuuagcuggaccaguaucacaacauaauuacagaccaggcuaucacacacaaacggcagggcccuggcaucuaggcaagcuugagauggacuuugaucuuugcgaaggaaccacagugguggugacugaggacuguggaaauagaggacccucucuaagaacaacuaccgccucuggaaaacucauaacagaaugguguugccgauccugcacauuaccaccgcuaagauacagaggugaggauggauguugguacggaauggaaaucagaccauugaaagagaaagaagagaacuuggucaacucuuuggucacagccgaacaugaacagauugacaacuucucacuaggagucuugggaauggcauuguuccuggaagaaaugcucaggacccgaguaggaacaaaacaugcaguauuacuaguugcaguuucuuucaugacauugaucacagggaacaugucuuuccgagaccuggggagagugaugguuauggugggggcugcuaugacggaugacauagguaugggcgugacuuaucuugcccuacuagcagcuuucaaaguuagaccaacuuuugcagcuggacuacuuuugagaaagcugaccuccaaggaauugaugaugaccaccauaggaaucguacuccucucccagaguaccauaccagagacuauacuugaacugacugaugcguuggccuugggcaugaugauccucaaaauagugagaaauauggaaaaguaucaacuagcagugacuaucauggcuaucuuauguguuccaaaugcaaugauauuacaaaaugcauggaaagugagcugcacaauacuggcagugguguccguuuccccacugcucuuaacaucuucacagcagaaagcggauuggauaccauuggcauugacgaucaaaggucucaauccaacagccauuuuccuaacaacccuuucaagaaccaauaagaaaaggaguuggccacuaaaugaggcuaucauggcagucgggauggugagcauuuuagccaguucucucuugaagaaugacauucccaugacaggaccauuaguggcuggagggcuucucacaguguguuaccugcuccccggaagauccgcugauuuggaacuggagagagccgccgaccuaagaugggaagaucaggcagagauaucaggaaguaguccaauucuguccauaacaauauccgaagauggcagcauguccauaaaaaaccaagaggaaaaacaaacacugaccauccucauuaaaaccggauugcuggugauauccgaacucuuucccguacaaauaccaaucacggcagcagcaugguaccugugggaagugaaaaaacaacgggcuggaguauugugggauguuccuucacccccaccugugggaaaggccgaacuggaagauggagccuauggaaucaagcagaaagggauucuuggauacucccagauuggggcgggaguuuacaaagaaggaacauuccacacaauguggcacgucacacggggugcuguucuaaugcauaaagggaagaggauugaaccaucaugggcggaugucagaaaagaucugauaucguauggaggaggcuggaagcuagaaggagaauggaaggaaggagaagaaguccaggucuuggcauuagagccuggaaagaauccaagagccguccaaacaagaccuggucuuuuuaaaacuaacacuggaaccauaggcgcuguaucucuagacuuuucuccuggaacgucaggaucuccaaucgucgacaaaaaaggaaaagucgugggucuuuauggcaauggugucgucacaagaaguggaacauaugugagugccauagcccagacugaaaaaagcauugaagacaauccagagauugaagaugacaucuuucggaaaaaaagauugaccauuauggaccuucacccaggagcgggaaagacgaaaagauaccuuccagcaauagucagagaggccauaaaacgaggcuugagaacacuaauccuggcccccacuagagucguagcagcugaaauggaggaagcucuuagaggacuuccaauaagauaccaaaccccagccaucagagcugagcacacugggcgagaaaucguggauuuaaugugucaugccacauuuaccaugaggcugcuaucaccaguuagagugccaaauuacaaccugaucauuauggaugaagcccauuucacagauccagcaagcauagcagcuagaggauacauuucaacucgaguagagaugggugaagcagccgggauuuucaugacagccacuccuccgggaagcagagacccauuuccucagagcaaugcaccaaucauggacgaggaaagagaaauuccugaacguucguggaacucuggacaugaguggguuacggacuuuaaaggaaagacuguuugguuuguuccgaguauaaaagcaggaaaugacauagcagcuugccugagaaaaaauggaaagaaagugauacaacucaguaggaaaaccuuugauucugaauacaucaagacuaggaccaaugauugggacuuuguggucacgacugauauuucagaaaugggugcuaacuuuaaggcugaaaggguuauagaccccaggcgcugcaugaaaccagucauacuaacagacggugaagagcgggugauccuggcagggcccaugccagugacucacucuagugcagcacaaagaagagggagaauaggaagaaauccaaaaaaugaaaaugaccaguacauauacaugggggaaccucuggaaaaugaugaagacugugcacacuggaaagaagcuaagaugcuucuagacaacaucaacacgccugaaggaaucauccccagcauguucgaaccagagcgugaaaagguggaugccauugauggugaauaccgcuuaagaggagaagcgaggaaaaccuuuguggaccuaaugagaagaggagaccugccagucuggcuggccuacagaguggcagccgaaggcaucaacuaugcagacagaaggugguguuuugauggaauaaagaacaaccaaauuuuggaagaaaauguggaaguggaaaucuggacaaaagaaggggaaaagaagaaauugaaacccagaugguuggaugcuaggaucuacucugacccgcuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagagacucuggagacauugcuuuugcugacacuuuuggcuacugucacgggcggaaucuuuuuauucuugaugagcggaaaagguauagggaaaaugacccugggaaugugcugcauaaucacggccaguauucuccuaugguacgcacaaauacagccacacuggauagcagcuucaauaauacuggaguuuuuucucauaguuuugcucaucccagagccagaaaagcagagaacaccccaagauaaccaauugacuuacguugucauagccauccucacagcgguggccgcaaccauggcaaacgagaugggguuccuggaaaaaacgaagaaagauuucggauugggaagcauugcaacccagccacccgagaguaacauccuggacauagaucuacguccugcaucagcauggacccuguaugccguggccacaacauuuaucacaucaauguugagacauagcauugaaaauuccucggugaaugugucucuaacagccauugccaaccaagccacagugcuaaugggucuugggaaaggauggccauugucaaaaauggacauuggaguuccccuucucgccaucgggugcuauucacaagucaaccccauaacucucacagcagcucuccuuuuauugguagcacauuaugcuaucauagggccaggacuccaagcuaaagcaaccagagaagcgcagaaaagagcagcagcaggcaucaugaaaaacccaacuguggauggaauaacagugauugaccuagauccaauacccuaugauccaaaauuugagaagcaacugggacaaguaaugcuccuaguccucugcgugacucaaguacugaugaugaggacuacaugggcuuugugugaggcucuaaccuuagcgaccgggcccaucuccacauugugggaaggaaauccaggaagauuuuggaauacaacuauugcagugucaauggcuaacauuuuuagaggaaguuacuuggcuggagcuggacuucucuuuucuaucaugaagaacacaaccaacacaagaaggggaacuggcaacacaggagagacgcuuggagagaaauggaaaaaccgauugaaugcauuggggaagagugaauuccagaucuacaagaaaagcggaauccaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguuguggcagagggggcuggucauacuauuguggggggcuaaagaauguaagagaagucaaaggccuaacaaaaggaggaccaggacacgaagaacccauucccaugucaacauauggguggaaucuagugcgucuccaaaguggaguugauguuuucuuuacuccgccagaaaagugugacacauugcugugugacauaggggagucgucaccaaaucccacgguugaagcaggacgaacacucagaguccuaaacuuaguggaaaauuggcugaacaacaacacccaauuuugcguaaagguucuuaacccauacaugcccucagucauagaaaaaauggaaacgcugcaaaggaaauacggaggagcuuuggugaggaauccacucucaagaaauuccacacaugagauguauuggguauccaaugcuuccgggaacauagugucaucagugaacaugauuucaaggauguugaucaacagauuuacaaugaggcauaaaaaagccacauacgagccagauguugaccuuggaagcggaacccgcaacaucggaauugaaagugagacaccaaaccuagacauaauugggaaaagaauagaaaaaauaaaacaagagcaugaaacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuugggcaacagcguguuuucaaagagaaaagugacacgagaacccaagaaccgaaagaaggcacgaagaaacuaaugaaaaucacgcccaaauggcucuggaaagaacuaggaaagaaaaagacacccaggaugugcacuagagaagaauucacaagaaaggugagaagcaaugcagccuuaggugccauauucacugaugagaacaaguggaagucggcacgugaggcuguugaagacaguagauuuugggaacugguugacaaggaaaggaaucuccaucuugaaggaaagugugagacauguguguacaacaugaugggaaagagagagaagaagcuaggggaauucggcaaagcaaaaggcagcagagccauaugguacauguggcuuggagcacgcuucuuagaguuugaagcccuaggauucuugaaugaagaucacugguuuucuagagagaacucccugaguggaguggaaggagaagggcugcacaagcuggguuacauucuaagagaugugagcaagaaagaagggggagcaauguacgcugacgacacugcaggaugggacacaagaaucacacuagaggacuuaaaaaaugaagaaaugggggccaaccaccuggaaggagaacccaaaaaacuuuaugaggccauuuuuaaauuaacguaccaaaacaagggggugcgugugcaaagaccaacaccaagaggcccauuaauggauauuauauugagaagagaccaaggagguaguggacaaguugguaccuauggccucaacacuuuuaccaauaugggagcccaacuaaucagacagauggagggagaaggagucuucaaaggcauccagcaccugauugccacagaagaaauugcagugcaagacugguuggcaagaguggggcgugagagguuuucaagaauggcuaucaguggagaugauuguguugugaaacccuuagaugacagguuugcaagcgcuuuaacagcucuaaaugacaugggaaaggagaggaaagucuuacaacaaugggaaccaucaagagaauggaacgauuggacacaagugccuuucuguucacaccauuuccaugaguuaaucaugaaagacggucguguacucguaguuccauguagaaaccaagaugaacugauugguagagcccgaauuucccagggagccggguggucuuugcgggagacggccugucuggggaaaucuuacgcccaaauguggagccagauguacuuucacaggcgugaccucaggcuggcggcaaacgcuauuugcucagcagucccaucacauuggguuccaacaagucgaacaacuugguccauacacgccagacaugaauggaugacaacggaagacauguugacaguuuggaacaggguguggauucaagaaaacccauggauggaagacaaaacuccaguggaaucaugggaggaaaucccauacuugggaaaaagagaagaccaauggugcggcucauugauagggcuaacaagcagggcuaccugggcaaagaauauccaaacagcaauaaaccaaguuagauccuuaauaggcaaugaggaauacacagacuauaugccauccaugaaaagauucagaagagaagaggaagaagcaggggucuugugguag

SEQ ID NO: 6503 - RNA, 9876 nt, Artificial Sequence
  derived and/or modified CDS sequence (wt) from DENV-2__JQ922550__SS-prME
acaguaggcaugaucaucaugcugauuccaacagugauggcgucccauuugaccacacgcaacggaggaccacacaugauugucauuggacaacagaaaaggaaaaccucuuucuucaaaacaaagaagggucacgacauguguacccucauggccauggccuuuggugaguuuugugaaaacacaaucacguauaaauguccuuuucucaagcagaacgaaccagaagacauagauuguuggugcaacuccacguccacauggguaacuuaugggacauguaccaccacaggagagcacagaagggaaaaaagaucaguggcucuuguuccacacgugggaaugggauuggagacacgaacugaaacauggaugucaucagaaggggccuggaaacaugcccagagaauugaaacuuggauucugagacauccagguuuuaccauaauggccgcaauccuggcauacaccauaggaacgacacauuuccaaagaguccugauauucauccuacugacagcuaucgcuccuucaaugacaaugcgcugcauaggaauaucgaauagggacuuuguggaaggagugucaggagggaguuggguugacauaguuuuagaacauggaaguugugugacgacgauggcaaaaaauaaaccaacacuggacuuugaacugauaaaaacagaagccaaacaacccgccacuuuaaggaaguacugcauagaggcuaaacugaccaacacgacaacagacucgcgcugcccaacacaaggggaacccacccugaaugaagagcaggacaaaagguuugucugcaaacacuccaugguagauagaggauggggaaauggauguggauuauuuggaaaaggaggcauugugaccugugcuauguucacaugcaaaaagaacaugaaaggaaaaauugugcagccagaaaaccuggaauacacugucgugauaacaccucacucaggggaagaacaugcagucggaaaugacacaggaaaacaugguaaggaagucaagauaacaccacagagcuccaucacagaggcggaacugacaggcuauggcacuguuacgauggagugcucuccgagaacgggccucgacuucaaugagaugguguugcugcaaauggaagacaaagcuuggcuggugcacagacaaugguuccuagaccuaccauugccauggcugcccggagcagacacacaaggaucaaauuggauacagaaagagacauuggucaccuucaaaaauccccaugcgaaaaaacaggauguuguuguuuuaggaucccaagagggggccaugcauacagcacucacaggggcuacggaaauccagaugucaucaggaaacuugcuguucacaggacaucucaaaugcaggcugagaauggacaaauuacagcuuaaagggaugucauacuccaugugcacaggaaaguuuaaagucgugaaggaaauagcagaaacacaacauggaacaauagucauuagaguacaauaugaaggagacggcucuccaugcaagauccccuuugagauaaaggaucuggaaaaaagacauguuuugggccgccugaucacagucaacccaauuguaacagaaaaggacaguccagucaacauagaagcagaaccuccguuaggagacagcuacaucaucauaggaguggaaccaggacaauugaagcuggacugguucaagaaaggaaguuccaucggccaaauguuugagaacacaaugaggggagcgaaaagaauggccauuuugggugacacagccugggauuuuggaucucugggaggaguguucacaucaauaggaaaggcucuccaccagguuuuuggagcaaucuauggggcugcuuucaguggggucucauggacuaugaagauccucauaggaguuaucaucacauggauaggaaugaacucacguagcacaucacugucugugucacugguauuagugggaaucgugacacuauacuugggagucauggugcaggccgacagugguugcggugggugugagcggaaaacaaaaacuaaauguggcaguggaauauucgucacagauaacgugcauacauggacagaacaauacaaguuccaaccagaauccccuucaaaacuggcuucagccauccagaaagcucaugaagagggcaucuguggaauccgcucaguaacaagacuggaaaaucuuauguggaaacagauaacaccagaauugaaucauauucuaucagaaaaugaagugaagcugaccaucaugacaggagacaucaaaggaaucaugcaggcaggaaaacgaucucugcgaccucaacccacugaguugagguauucauggaaaacaugggguaaagcgaaaaugcucuccacagaacuccacaaucagaccuuccucauugauggucccgaaacagcagaaugccccaacacaaacagagcuuggaacucacuggaaguugaggacuacggcuuuggaguauucaccaccaauauauggcuaagauugagagaaaagcaggauguauuuugugacucaaaacucaugucagcggccauaaaggacaacagagccguccaugcugauauggguuauuggauagaaagcgcacucaaugacacauggaagauagagaaagcuucuuucauugaaguuaaaaguugccacuggccaaagucacacacucuaugggguaauggagugcuagaaagcgagaugguaauuccaaagaauuucgcuggaccagugucacaacauaauaacagaccaggcuauuacacacaaacagcaggaccuuggcaucuaggcaagcuugagauggacuuugauuucugcgaagggacuacaguggugguaaccgaggacuguggaaacagagggcccucuuuaagaacaaccacugccucaggaaaacucauaacggaaugguguugucgaucuugcacuuuaccacccccuaaauacagaggugaggauggaugcugguacgggauggaaaucagaccauugaaagagaaagaagaaaaucuggucaguucucugguuacagccggacaugggcagaucgauaauuucucauuaggaaucuugggaauggcacuguuccuugaagaaaugcucaggacucgaguaggaacgaaacaugcaauauuacuagucgcaguuucuuucgugacguuaaucacagggaacaugucuuuuagagaccugggaagagugaugguuaugguaggugccaccaugacagaugacauagguaugggugugacuuaucuugcucuacuagcagcuuucaaagucagaccaaccuuugcagcuggacugcucuugagaaaacugaccuccaaggaauuaaugaugaccaccauaggaaucguucucucuucccagaguagcauaccagagaccauucuugaacugacugaugcguuagcuuugggcaugaugguccucaagauggugagaaacauggaaaaauaucagcuggcagugaccaucauggccauuuugugcgucccaaaugcugugauauuacaaaacgcauggaaagugaguugcacaauauuggcaguggugucuguuuccccccugcucuuaacauccucacaacagaaagcggauuggauaccauuagcauugacgaucaaaggucucaauccaacagccauuuuucuaacaacccucucaggaaccagcaagagaaggagcuggcccuuaaaugaggccaucauggcgguugggauggugaguaucuuggccagcucucucuuaaagaaugacauccccaugacaggaccauuaguggcuggagggcuccuuacugugugcuacgugcuaacugggcggucagccgaucuggaauuagagagagcuaccgaugucaaaugggaugaccaggcagagauaucagggagcaguccaauuuugucaauaacgauaucagaagauggcagcaugucaauaaagaaugaagaggaagagcaaacacugacuauacucauuagaacaggauugcuugugaucucaggacucuuuccgguaucaauaccaauuacagcagcagcaugguaccugugggaagugaagaaacaacgggcuggaguguugugggauguccccucaccaccacucgugggaaaggccgaacuggaagauggagcuuacagaaucaagcaaaaaggaauccuuggauauucccagaucggagccggaguuuacaaagaaggaacauuucacacaauguggcacgucacacguggcgcuguccuaaugcacaaggggaagaggauugaaccaucaugggcggacgucaagaaagacuugauaucauauggaggagguuggaagcuagaaggagaauggaaagaaggagaagaaguccaggucuuggcauuggagccugggaaaaauccaagagccguccaaacaaaaccuggccuuuuuagaaccaauacuggaaccauaggugccguaucucuggacuuuuccccugggacgucaggaucuccaaucgucgacaaaaaaggaaaaguuguaggucucuauggcaauggugucguuacaaggaguggagcauaugugagugccauagcccagacugaaaaaagcauugaagacaauccagagauugaagaugacaucuuucgaaagagaagauugacuaucauggaucuccacccaggagcaggaaagacaaagagauaccucccggccauagucagagaggccauaaaaagaggcuugagaacacuaauccuagcccccacuagagucguggcagcugaaauggaggaagcccuuagaggacuuccaauaagauaccaaaccccagcuaucagggcugagcacaccgggcgggagauuguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaaucuuuaugacagccacuccuccggguagcagagauccauuuccucagagcaaugcaccaauuauggacgaagaaagagaaauuccggaacguucauggaacucagggcaugagugggucacggauuuuaaaggaaagacugucugguuuguuccaagcauaaaaaccggaaaugacauagcagccugccugagaaagaauggaaagagggugauacaacucagcaggaagaccuuugauucugaguaugucaagacuagaaccaaugacugggauuucgugguuacaacugacaucucggaaaugggcgccaacuuuaaagcugagaggguuauagaccccagacgcugcaugaaaccaguuauacugacagacggcgaagagcgggugauucuggcaggacccaugccagugacccacucuagugcagcacaaagaagagggagaauaggaaggaauccaaagaaugaaaaugaucaauauauauauaugggggaaccccuggaaaaugaugaagacugcgcgcacuggaaggaagcuaagaugcuccuagauaacaucaacacaccugaaggaaucauucccagcauguucgagccagagcgugaaaagguggaugccauugacggugaauaucgcuugagaggagaagcacgaaaaaccuuacuggagcuaauaagaggaggaccuauaccagucuacuuaggcuauaaguggccaggcgaagguaucaacuacgcagacaguagauuguguguuggacgaacccagaacaaucaaaucuuggaagaaaauguagaaguggaaaucuggacaaaggaagggaaagggaaaaaauugaaaccuagaugguuggaugcuaggaucuacuccgauccacuggcgcuaaaagaauucaaggaauucgcagccggaagaaagucccuaacccugaaccuaaucacagagaugggcagacucccaacuuuuaugacucagaaggccagagaugcacuagacaaccuggcggugcugcauacggcugaagcggguggaaaggcauacaaucaugcucucagugaacuaccggagacccuggagacauugcuuuugcugacacuguuggccacagucacgggaggaaucuuucuauuccugaugagcggaagggguauagggaagaugacccugggaaugugcugcauaaucacggcuagcauccucuuaugguaugcacaaauacaaccacauuggauagcagcuucaauaauauuggaguucuuucucauaguccugcucauuccagaaccagaaaagcagaggacaccccaggauaaucaauugaccuacgucaucauagccauccucacagugguggccgcaaccauggcaaacgaaauggguuuucuggaaaaaacaaaaaaagaccucggacugggaaacauugcaacucagcaaccugagagcaacauucuggacauagaucuacguccugcaucagcauggacguuguaugccguggcuacaacauuuaucacaccaauguugagacauagcauugaaaauuccucaguaaaugugucccuaacagccauagcuaaccaagccacagugcuaaugggucucgggaaaggauggccauugucaaagauggacauuggaguuccccuccuugcuauuggguguuauucacaagucaaccccauaacccucacagcggcucuucuuuuauugguagcacauuaugccaucauaggaccgggacuucaagccaaagcaaccagagaagcucagaaaagagcagcagcgggcaucaugaaaaacccaacuguggacggaauaacagugauagaucuagauccaauacccuaugauccaaaguuugaaaagcaguugggacaaguaaugcuccuaguccucugugugacccaagugcugaugaugaggacuacgugggcuuugugcgaagccuuaacucuagcaaccggacccgucuccacauugugggaagggaauccaggaagauucuggaacacaaccauucugauacaaauggcaaacauucuuagagggaguuaccuggcuggagcuggaccucuuuuuuccaucauggagaacacaaccggcccgagaagaagaacuggucaacuagggagagagcugcuuaggagauggaaaagcagacugaacgcauuggggaaaagugaauuccagaucuacaagaaaaguggaauucaagaaguggacagaaccuuagcaaaagaaggcauuaaaagaggagaaacggaucaucacgcugugucgcgaggcucagcaaaauugagaugguucguugaaagaaauuuggucacaccagaagggaaaguaguggaccuugguuguggcagagggggcuggucauacuauuguggaggauuaaagaauguaagagaaguuaaaggcuuaacaaaaggaggaccaggacacgaagaaccuaucccuaugucaacauauggguggaauuuaguacgcuuacagagcggaguugacguuuuuuuuauuccaccagagaggugugacacauuguugugugacauaggggaaucaucaccaaaucccacgguagaagcgggacgaacacucagaguccucaaccuaguggaaaauuggcugaacaauaacacccaauuuugcauaaagguucuuaacccguacaugcccucagucauugaaaaaauggaaaccuuacaacggaaauacggaggagcuuuggugagaaauccacucucacggaauuccacacaugagauguacuggguguccaaugcuuccgggaacauagugucaucagugaauaugauuucaagaaugcugauuaacagauuuaccaugagacacaagaaggccacuuaugagccagaugucgaccucggaagcggaacccgcaauauuggaauugaaagugagauaccgaaccuagacauaauugggaaaagaauagaaaaaauaaaacaagagcaugaaacgucauggcacuaugaccaagaccacccauacaaaacaugggcuuaccauggcagcuaugaaacaaaacagacuggaucagcaucauccauggugaacggaguagucagauugcugacaaaacccugggacguuguuccaauggugacacagauggcaaugacagacacaacuccuuucggacaacagcgcgucuuuaaagagaagguggacacgagaauccaagaaccaaaagaaggcacaaaaaaacuaaugaaaauuauggcagaguggcucuggaaagaacuaggaaagaaaaagacaccuagaaugugcaccagagaagaauucacaaaaaaggugagaagcaaugcagccuugggggccauauucaccgaugagaacaaguggaaaucagcgcgugaggcuguugaagacgguagguuuugggagcugguugacagggaaaggaaucuccaucuugaagggaaaugugaaacauguguguacaacaugaugggaaaaagagagaaaaaacuaggagaguuuggcaaagcaaaaggcagcagagccauaugguacauguggcuuggagcacgcuucuuagaguuugaagcccuaggauuuuugaaugaagaccauugguucuccagagagaacucccugaguggaguggaaggagaagggcugcacaagcuagguuacaucuugagagaggugagcaagaaagaaggaggagcaauguaugccgaugacaccgcaggcugggacacaagaaucacacuaggggcuuuaaaaaaugaaagaaaguguaccgaacacauggagggagaacccaggaaaccuggccgaggccauuuuaaauggcguaaccaaaacaggguggugggggugcaaggcccaacaccaggaggcacgguaauggacaucauaucgaggaagaaccaaagggguaguggacaaguugguaccuacggccucaacacuuucaccaacauggaagcacaauuaauuaggcaaauggagggggagggauucuucauagaacaucagcacuugacagccucagaagaaaaugcugugcaagauugguuagcaagaguagggcgugaaaagguuucaagaaugcccaucaguggagaugauuguguugugaaaccuuuagaugauagauuugcaagagcucuaacagcucuaaaugacaugggaaagguuaggaaggacauacagcaaugggagcccucaagaggauggaacgacuggacacaggugcccuucuguucacaccauuuucacgaguuaauuaugaaagauggucgcacacucguaguuccaugcagaaaccaagaugaauugauuggcagagcccgaauuucccagggagcuggguggucuuucggugagacugccuguuuggggaagucuuacgcccaaauguggaguuugauuaacuuccgcauaccugaucucaggcuagcggcaaauguuaucugcucgguagucccgucacacuggguuccaacaagccggacaaccugguccauacacgccaaccaugaauggaugacgacggaagacauguugacaguuuggaacagaguguggauccuagaaaauccauggauggaagacaaaacucccguggaaucaugggaggaaaucccauaccuggaaaaaagagaagaccaauggugugguucacugauugggcugaccccccagccacccugggcgaagaauaucgagacagcaauaaaccaagucagaucccucauuggcaaugaggaauacauagauuacuugccauccaugaaaagauucagaauagaagaggaagagucuggauuuuugugguag

SEQ ID NO: 6504 - RNA, 9876 nt, Artificial Sequence
  derived and/or modified CDS sequence (wt) from DENV-2__JQ922553__SS-prME
acugcaggaaugaucaucaugcugauuccaacagugauggcguuucauuugaccacacgcaacguagaaccacccaugauuuucaguagacaagaaaaagggaaaagcuuuuuguuuaagacaaaggauggccacgacauguguaccuucauggccauggaccuuggugaguugugugaagacacaaucacguauaaauguccuuuucucaagcagaacgaaccagaagacauagauuguuggugcaacuccacguccacauggguaacuuaugggacauguaccaccacaggagagcacagaagagaaaaaagaucaguggcgcuuguuccacacgugggaaugggauuggagacacgaacugaaacauggaugucaucagaaggggccuggaaacauguccagagaauugaaacuuggauccugagacauccaggcuuuaccauaauggccgcaauucuggcauacaccauaggaacgacgcauuuccaaagaguccugauauucaucuuacugacaggggucgcuccuucaaugaggaugcgcugcauaggaauaucaaauagggacuuuguggaaggagugucaggagggaguuggguugacauaguuuuagaacauggaaguugugugacaacgauggcaaaaaauaaaccaacacuggaccuugaacugauaaaaacagaagccaaacaacccgccacucuaaggaaguacuguauagaggcuaaacugaccaacacgacaacagacucgcgcugcccaacacaaggggaacccacccugaaugaagagcaggacaaaagguuugucugcaaacacuccaugguagacagaggauggggaaauggauguggauuauuuggaaaaggagccaucgugaccugugcuauguucacaugcaaaaagagcaugaaaggaaaaauugugcagccagaaaacuuggaauacacugucgugauaacaccucacucaggggaagaauaugcagucggaaaugauacaggaaaacaugguaaggaagucaagauaacaccacagagcuccaucacagaggcggaacugacaggcuauggcacuguuacgauggagugcucuccgagaacgggccucgacuucaaugagaugguguugcugcaaauggaagacaaagcuuggcuggugcacagacaaugguuccuagaccuaccguugccauggcugcccggagcggacacacaaggaucaaauuggauacagaaagagacauuggucaccuucaaaaauccccaugcgaaaaaacaggauguuguugucuuaggaucccaagagggggccaugcauacagcacucacaggggcuacggaaauccagaugucaucaggaaacuugcuguucacaggacaucucaaaugcaggcugagaauggacaaauuacagcuuaaagggaugucauacuccaugugcacaggaaaguuuaaaguugugaaggaaauagcagaaacacaacauggaacaauagucauuagaguacaauaugaaggagacggcucuccaugcaagauccccuuugagauaauggaucuggaaaaaagacauguuuugggccgccugaucacagucaacccaauuguaacagaaaaggacaguccagucaacauagaagcagaaccuccauucggagacagcuacaucaucauaggaguggaaccaggacaauugaagcuggacugguucaagaaaggaaguuccaucggccaaaugcuugagacaacaaugaggggagcgaaaagaauggccauuuugggugacacagccugggauuuuggaucucugggaggaguguucacaucaauaggaaaggcucuccaccagguuuuuggagcaaucuauggggcugcuuucaguggggucucauggacuaugaagauccucauaggaguuaucaucacauggauaggaaugaacucacguagcacaucacugucugugucacugguauuagugggaaucgugacacuauacuugggaguuauggugcaggccgauagugguugcguugugagcuggaagaacaaagaacuaaaauguggcaguggaauauucgucacagauaacgugcauacauggacagaacaauacaaguuccaaccagaauccccuucaaaacuggcaucagccauccagaaagcucaugaagagggcauuuguggaauccgcucaguaacaagacuggaaaaucuuauguggaaacagauaacacuagaauugaaucauauucuaucagaaaaugaagugaagcugaccaucaugacaggagacaucaaaggaaucaugcagguaggaaaacgaucucugcggccucaacccacugaguugagguauucauggaaaacaugggguaaagcgaaaaugcucuccacagaacuccacaaucagaccuuccucauugauggucccgaaacagcagaaugcccaaaugcaaacagagcuuggaauucacuggaaguugaggacuacggcuuuaggaaguauaaaaccaaaauauggccaacauugaaagaauggcggaaaguauuuugugacucaaaacucaugucagcggccauaaaggauaacagagccguccaugcugauauggguuauuggauagaaagcgcacucaaugacacauggaagauagagaaagcuucuuucauugaaguuaaaaguugccacuggccaaagucacacacucuaugggguaauggagugcaagaaagcgagaugguaauuccaaagaauuucgcuggaccagugucacaacauaauaacagaccaggcuauuacacacaaacagcaggaccuuggcaucuaggcaagcuugagauggacuuugauuucugcgaagggacuacaguggugguaaccgaggacuguggaaacagagggcccucuuuaagaacaaccacugccucaggaaaacucauaacggaauggugcugucgaucuugcacauuaccaccgcuaagauacagaggugaggcuggaugcugguacuggauggauaucagaccauugaaggagaaagaaaaaaaucuggucaguucucuaguuacagccggacaugggcagauugauaauuucucauuacgaaucuugggaauggcauuguuccuugaaaaaaugcucaugacucgacuuggaacgaaacaugcaauauuacuagucgcaguuucuuucgugacguuaaucacaaggaacaugucuuuuaaagaccugggaagagugaugguuauggugggugccaccaugacggaugacaugcguaugggugugacuuaucuugcucuacuaccagcuuucaaagucagaccuaccuuugcaacuggacugcucuugagaaaacugaccuccaaggaauugaugaugaccaccauaggaaucguucuuuucucccagaguagcauaccagagaccauucuugaacugacugaugcguuagccuugggcaugaugguccucaagauggugagaaacauggaaaaauaucagcuggcagugaccaucauggcuauuuuaugcgucccaaaugcugugauauuacagaacgcauggagagugaguugcacaauauuggcaguggugucuguuuccccccuguucuuaacauccucacgacagaaagcggauuggauaccauuagcauugacgaucaaaggucucaauccaacagccauuuuucuaacaacccuuucaagaaccagcaagaaaaggagcuggccuuuaaaugaggccaucauggcgguugggauggugagcaucuuggccagcucucucuuaaagaaugacauccccaugacaggaccauuaguggccggagggcuucuuacugugugcuacgugcuaacugggcggucagccgaucuggaauuagagagagcugcugaugucaaaugggaugaccaggcagagauaucagggagcaguccaauucugucaauaacaauaucagaagacggcagcaugucaauaaagaaugaagaggaagagcaaacacugacuauacucaucagaacaggauuacuugugaucucaggacucuuuccgguaucaauaccaaucacagcagcagcaugguaccugugggaagugaagaaacaacgggcuggaguguugugggauguccccucaccaccaccagugggaaaggcugaacuggaagauggagccuacagaauccagcaaaaaggaauuuuuggauauucccagaucggagccggaguuuacaaagaaggaaccuuccccacaauguggcacgucacacguggcgcuguccuaaugcauaaggggaagaggauugaaccaucaugggcggacgucaagaaagacuuaauaucauauggaggagguuggaagcuagaaggagaauggaaagaaggagaagaaguccaggucuuggcauuggagccugggaaaaauccaagagcuguccaaacaaaaccuggccuuuuuaaaaccaacacuggaaccauaggugccguaucucuggacuuuuccccugggacgucaggaucuccaaucgucgacaaaaaaggaaaaguugugggucucuauggcaauggagucguuacaaggaguggagcauaugugagugccauagcucagacugaaaaaagcauugaagacuauccagagguugagauggacaucuuucggaagaagagguugacuaucauggauuuccacccaggagcaggaaggcaaaagagauacuucccggccauagucagagaggccauaaaaagaggcuugagaacacuaauccuagcccccacuagagucguggcagcugaaauggaggaagcccuuagaggacuuccaauaagauaccaaaccccagcuaucagggcugagcacacugggcgggagauuguagacuuaaugugucaugccacauuuaccaugaggcugcuaucgccaaucagggugccaaauuacaaccugaucaucauggacgaagcccauuuuacagauccagcaagcauagcagcuaggggauacaucucaacucgaguggagaugggugaggcagcuggaaucuuuaugacagccacuccuccggguagcagagauccauuuccucagagcaaugcaccaaucauggacgaagaaagagaaauuccggaacguucguggaacuccgggcaugagugggucacggauuuuaaaggaaagauuguuugguuuguuccaagcuuaaaaaccggaaaauacauagcagcuugcuugagaaagaauggaaagagggugauacaacucaguaggaagaccuuugauucugaauaugucaagacuagaaccaaugacugggauuucgugguuacaacugacaucucggaaaugggcgccaacuuuaaagcugagaggguuauagaccccagacgcugcaugaaaccaguuauacugacagacggcgaagagcgggugauucuggcaggacccaugccagugacccacuccagugcagcacaaagaagagggagaauaggaaggaauccaaagaaugaaaaugaucaauauauauauaugggggaacccuuggaaaaugaugaagacugugcgcacuggaaggaagcuaagaugcuccuagauaacaucaauacaccugaaggaaucauuccuagcauguucgagccagagcgugaaaagguggaugccauugacggugaauaucgcuugagaggagaagcaaggaaaaccuuacuggagcuaauaagaggaggaccuauaccagucuacuuaggcuauaaguggccaggcgaagguaucaacuacgcagacaguagauuguguuuugauggaaucaagaacaaccaaaucuuggaagaaaacguggaaguggaaaucuggacaaaagaaggggaaaggaaggaauugaaacccagaugguuggaugcuaggauauacucugacccacuggcgcuuaaagaauucaaggaauucgcagccggaagaaagucccuaacccugaaccuaaucacagagaugggcagacucccaacuuuuaugacucagaaggccagaggugcccuugccagucugaugguccugcauacggcugaagcaggcggaagggcguacaaucaugcucucagugaacugccagagacccuggagacauugcuuuugcugacacuguuggccacagucacgggaggaaucuuucuauuccugaugagcggaagggguauagggaagaugacccuuggaaugugcugcauaaucacggccagcauccucuuaugguaugcacaaauacaaccacauuggauagcagcuucaauaauauuggaguucuuucucacaguuuugcucauuccagaaccagaaaagcagaggacaccccaagauaaucaauugaccuaugucaucauagccauccucacagugguggccgcaaccauggcaaacgaaaugggcuuucuggaaaaaacaaagaaagaucucggacugggaaacauugcaacucagcaauccugcaaaaagauuuuggacauauaucuaggcccugcucuaccauggaaguuguaugccggggggacaacauuuaucacaccaauguugagacauagcauugaaaauuccucaguaaaugugucccuaacagccauagcuaaccaagccacagugcuaaugggucucgggaaaggauggccauugucaaagauggacauuggagucccccuccuugcuauuggguguuacucacaagucaaccccauaacccucacagcggcucuuuuuuuauugguagcacauuaugccaucauaggaccaggacuucaagccaaaccaaccagagaagcucagaaaagagcagcagcgggcaucaugaaaaacccaacuguggauggaauaacagugauagaucuagauccaauacccuaugauccaaaguuugaaaagcaguugggacaaguaaugcuccugguccucugugugacccaagugcugaugaugaggacuacgugggcuuugugugaagcuuuaacucuagcaaccggacccguguccacauugugggaaggaaauccagggagauucuggaacacaaccauugcagugucaauggcaaacaucuuuagagggaguuacuuggcuggagcuggacuucucuuuucuaucaugaagaacacaaccagcacgagaagaggaacugguaacauaggagaaacgcuaggagagaaauggaaaagcagacugaacgcauuggggaaaagugaauuccagaucuacaagaaaaguggaauucaagaaguggacagaaccuuagcaaaagaaggcauuaaaagaggagaaacggaucaucacgcugugucgcgaggcucagcaaaacugagaugguucgacgaaagaaauuuggucacaccagaagggaaaguaguggaccuugguuguggcagaggggguuggucauucuuuuguggaggauuaaagaauguaagagaagucaaagcauuaacaauaggagggccaggacacgaagaaccuauccucaugucaacauaugggcggaauuuaguacguucccagagcggaguugucguuuuucauacuccaccagagaagugugacacaucguugcgugacauaggggagucgucaccaaaucccacgguugaagcaggacgaacacucagaguccuaaacuugguagaaaauuggcugaacaacaacacccaauuuugcauaaagguucuuaacccauacaugcccucaguuauagaaaaaauggaagcgcugcaaaggaaauacggaggagcuuuggugaggaauccacucucaagaaauuccacacaugagauguauuggguauccaaugcuuccgggaacauagugucaucagugaacaugauuucaaggauguugaucaacagauuuacaaugagacauaaaaaagccacauacgagccagauguugaccucggaagcggaacucgcaacaucggaauugaaagugagacaccaaaccuagacauaauugggaaaagaauagaaaaaauaaaacaagagcaugagacaucauggcacuaugaccaagaccacccauauaaaacaugggguucccauggcagcuacgaaacaaaacagacuggaucagcaucauccauggugaacggaguagucagauugcugacaaaacccugggacguuguuccaauggugacacagauggcaaugacagacacaacucccuucggacaacagcgcgucuucaaagagaagguggauacgagaacccaagaaccaaaagaaggcacaaaaaaacuaaugaaaaucacggcagaguggcucuggaaagaacuaggaaagaaaaagacaccuagaaugugcaccagagaagaauucauaaaaaaggugagaaguaaugcagccuugggggccauauucaccgaugagaacaaguggaaaucggcgcgugaggcuguugaagaugguagguuuugggagcugguugacaaggaaaggaaucuccaucuugaagggaaaugugaaacauguguguacaacaugaugggaaaaagagagaaaaaacuaggagaguuuggcaaagcaaaaggcagcagagccauaugguacauguggcuuggagcacgcuucuuagaguuugaagcccuaggauuuuugaaugaagaccauugguucuccagagagaacucccugaguggaguggaaggagaagggcugcacaagcuagguuacaucuuaagggaggugagcaagaaagaaggaggagcaauguaugccgaugacaccgcaggcugggacacaagaaucacacuagaggauuuaaaaaaugaagaaaggaagacgaaccacauggggggagaacacaggaaacuugcccgaggcauuuuuaaaaugaaccuaacaaacaagguggugcgggugcaaagaccaacaccgggaggcacguuaauggacaucauaucgagaaagacccaaaggggaagugaacaaguugguaccuauggccucaccacuuuaaccaaucuggaagccccaccuauuagacagauggagggaaaaggaguuuucaaagggcaucagcaccgaacagccucagaagaaaacgcugugcaagauuggcuagcaagaguagggggugaaagguugucaagauuggcuauuaguggagaugauuguguugugaaaccucuagaugauagauuugcaagagcccuaacagcucuaaaugacaugggaaagguuaggaaggacauacagcaaugggagcccucaagaggauggaacgacuggacacaggugcccuucuguucacaccauuuucacgaguuaauuaugaaagauggucguacacucguagucccaugcagaaaccaagaugaacugauuggcagagcccggauuucccagggagcuggguggucuuuacgggagacggccuguuuggggaaguuuuacgcccaaagguggagcuugauguacuuccacagacgugaucucaggcuagcaccaaaugccaucugcucggcaguccggacacacuggguuccaacaagccggaaaaccuggccaauacacgccagccaugauuggaugacaacagaagucaugcugacaguuuggaacaaauugugguuccaagaaaauccauggauggaagacaaaacuccagugggauucugggaggaaauuccauuccuggaaaaagggaaagaccaauggggcggcucacuuauugggcugacaagcagaccccccugggcgaagaacuuccagccagcaauaaaccaagucagaucccuucuuugcaaugaggaauccgcagauuucaugccauccaugaaaagauucagaagagaagaggaagaggcaggaguuuugugguag

SEQ ID NO: 6505 - RNA, 9876 nt, Artificial Sequence
  derived and/or modified CDS sequence (wt) from DENV-2__JQ922549__SS-prME
acugcaggcgugaucaucaugcugauuccaacagcgauggcguuccauuuaaccacacgcaacggagaaccacacaugaucgucagcagacaagagaaagggaaaagucucuuguuuaaaacagaggauggugugaacauguguacccucauggccauggaccuuggugaacugugugaagacacaaucacuuauaacuguccucuucucaggcagaaugaaccagaagauauagauuguugguguaacuccacguccacauggguaacuuaugggacaugcacugccccaggggaccacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauauuuccaaagaguccugauccucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaacgaaguacuguauagaggcaaagcugaccaacacaacaacagcaucucgaugcccaacacaaggggaacccagccuaaaugaagagcagcacaaaagguucgucugcaaacauuccaugguagacagaggauggggaaauggauguggauuauuuggaaagggaggcaucgugaccugugcuauguucacaugcaaaaagaacaugaaaggaaaaauugugcaaccagaaaaccuggaauacaccauugugguaacaccucacucaggggaagagaaugcaguuggaaaugacacaggaaaacauggcaaggaaaucaaaguaagaccacagaguuccauuacagaagcagaacugacaggcuauggcacugucaccauggagugcucuccaagaacgggcuucgcauucaaugagaugguguugcugcaaauggaaaauaaagcuuggcuggugcacaggcaaugguucuuagaccugccguuaccaugguugcccggagcggacacacaaggaucaaauuggauacagaaggagacauuggucaccuucaaaaauccccaugcgaagaaacaggauguuguuguuuuaggaucccaagaaggggcuaugcauacagcucuuacaggggccacggaaauccagaugucaucaggaaaccuacuguucacaggacaucucaagugcaggcugagaauggauaaacuacagcucaaaggaaugucauacucuauguguacaggaaaguuuaaaguuguaaaggaaauagcagaaacacaacauggaacaauaguuaucagaguacaauaugaaggggauggcucuccauguaaaaucccuuuugagauaauggauuuagaaaaaagacuugucuuaggucgccugaucacagucaacccaaucgucacagaaaaagacaguccagucaacauagaagcagaaccuccauucggagacagcuacaucauuauaggaguagaaccgggacaacugaagcccagcugguuuaagaaaggaagcucaauccgccaaauguucgagacaacaaugagaggagcgaagagaauggccauuuuaggugacacagccugggacuuuggaucccugggaggaguguucacaucuauaggaaaggcccuccaccaaguuuuuggagcaaucuauggggcugccuucaguggggucucauggacuaugaaaauccucauaggaguugucaucacauggauaggaacgaauucacguagcaccucacugucugugucauuaguauuagugggagucgugacauuguauuugggagucauggugcaggcugauagugguuguguugugaguuggaaaaacaaagaacugaaauguggcagugggauuuuuaucacagacaauguacacacauggacagaacaauacaaauuccaaccagaaucccccucaaagcuggcuucagcuauccagaaagcucaugaagagggcauuuguggaauccgcucaguaacaagacuggagaaucuaauguggaaacaaauaacaccagaacugaaucacauucuaucagaaaaugagguaaaguugacuaucaugacaggagacaucaaaggaaucaugcaggcaggaaaacgaucccugcggccccagcccacugagcugaaguauucauggaaaacguggggcaaagcgaaaaugcucuccacagagccucauaaccagaccuuucucauuggcggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaauggagugcuagaaagugagaugauaauuccaaagaauuuugcuggaccaguaucacaacauaauuacagaccaggcuaccacacacaaacggcaggacccuggcaucuaggcaagcuugagauggacuuucauuuuugcgaaggaaccacagugguggugacugaggacuguggaaauagaggacccucucuaagaacaacuaccgcuucuggaaaacucauaacagaaugguguugccgauccugcacauuaccaccacuaagauacagaggugaggauggaugcugguacggaauggaaaucaggcccuuggaaggggaagagggggacuugguccauucuuuggucacagccggacauggacagauugacaacuucucacuaggagucuugggaauggcacuguuccuggaagaaaugcucaggacccgaguaggaacaaaacaugcaguauuacuaguugcaguuucuuucaugacauugaucacagggaacaugucuuuccgagaccuggggagagugaugguuauggugggggcugcuaugacggaugacauagguaugggcgugacuuaucuugccuuacuagcagccuucaaaguuagaccaacuuuugcagcuggacuacuuuugagaaagcugaccuccaaggaauugaugaugaccaccauaggaaucguacuccucucccagagcaccauaccagagacuauacuugaacugacugaugcguuggccuugggcaggaugauucucaagauagugagaaauauggaaaaguaucaauuagcagugacuaucauggcuaucuuauguguuccaaaugcagugauauuacaaaaugcauggaaagugagcugcacaauacuggcagugguguccguuuccccacugcucuuaacaucuucacagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagccaguucucucuuggagaaugacauucccaugacaggcccauuaguggcuggagggcuucucacuguguguuacgugcucacuggaagaucggcugacuuggaacuggagagagccgccgacguaagaugggaagaucaggcagagauaucaggaagcaguccaauucugucaauaacaauaucggaagauggcagcaugucgauaaaauaugaagaggaagaaccaacgcugaccauacucauuagaacaggauugcuggugauaucaggacuuuuucccguaucaauaccaaucacggcagcagcaugguaccugugggaagugaagaaacaacgggcuggaguauugugggauguuccuucacccccaccugugggaaaggccgaacuggaagauggagcuuauagaaucaagcaaaaagggauucuuggauccucccagaucggagcucgaguuuacaaagaaggaacauuccacacaauguggcacgucacacguggugcuguucuaaugcauaaagggaagaggauugaaccaucaugggcggaugucaggaaagaccuaauaucauauggaggaggcuggaaacuagaaggagaauggaaggaaggagaagaaguccaggucuuggcauuagagccuggaaagaauccaagagccguccaaacaaaacccggucuuuuuaaaacuaacaccggaaccauaggcacugugucucuagacuuuucuccuggaacgucagaaucuccaaucgucgacaaaaaaggaaaagucgugggucucuauggcaauggugucgucacaaggaguggaacauaugugagugccauagcccagacugaaaaaagcauugaagacaauccagagauugaagaugacaucuuucggaaaaaaagauugaccauuauggaccuccacccaggagcgggaaagacgaaaagauaccuuccagcaauagucagagaggccauaaaacgaggccuaagaacauuaauccuggcccccacuagagucguggcagcugaaauggaggaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagccagaggauacauuucaacucgaguagagaugggugaagcagcugggauuuucaugacagccacuccuccgggaagcagagacccauuuccucagagcaaugcaccaaucauggaugaagaaagggaaaucccugaacguucguggaauucuggacaugaguggguuacagauuuuaaagggaagacuguuugguuuguuccgaguauaaaagcaggaaaugauauagcagcuugccugagaaaaaauggaaagaaagugauacaacucaguaggaagaccuuugauucugaauacaucaagacuaggaccaaugauugggacuuuguggucacgacugacauuucagaaaugggugcuaacuuuaaggcugaaaggguuauagaccccaggcgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauuccuagcauguucgaaccagagcgugaaaagguggaugccauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggggaaaggaagaaauugaaacccagaugguuggaugcuaggaucuacucugacccacuggcgcuaaaagaauucaaagaguuugcagcuggaagaaaaucccugacccugaauuuaaucacagaaauggguaggcuuccaaccuuuaugacucagaaagcaaggaacgcacuggacaacuuagcaguccugcauacggcugaagcaggcggaagggcguacaaucaugcucucagugaacugccagagacccuggagacauugcuuuugcugacacuuuuggccacagucaccggcggaaucuuuuuauucuugaugaguggaaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcagagaacaccccaagauaaccaauugacuuacguugucauagccauccucacagugguggccgcaaccauggcaaacgagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccccagugaaugugucucuaacagccauugccaaucaagccacaguguuaaugggucuugggaagggauggccauugucaaaaauggacauugggguucccccucucgccaucgggugcuauucgcaagucaaccccauaacccucacagcagcccuucucuuauugguagcacauuaugcuaucauagggccaggacuccaaguaaaagcaaccagagaagcucagaaaagagcagcagcgggcaucaugaaaaacccaacuguggauggaauaacagugauugaccuagauccaauacccuaugauccaaaauuugagaagcagcugggacaaauaaugcuccgaguccucugcgugacucaaguacugaugaugaggacuacaugggcuuugugugaggcucuaaccuuagcgaccgggcccaucuccacauugugggaaggaaauccagggagauuggggaauacaaccauugcagugucaauggcuaacaucuuuaggggaagcuacuuggcuggagcuggacuucucuuuuccaucaugaagaacacaacaaacacaagaagaggaacuagcaaccuaggagagacgcuuggagagaaauggaaaaaccgauugaauucauuggggaagagugaauuccagaucuacaagaaaagcggaauccaggaaguggauagaaccuuggcaaaagaaggcauuaaaaagggagagacggaccaucacgcugugucacgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggagaagauguuuucuuuacuccgccagaaaagugugacacauuguugugugacauaggggagucgucaccaaaucccacgguugaagcaggacgaacacucagaguccuaaacaugguagaaaauuggcugaacaacaacacccaauuuugcauaaagguucuuaacccauacaugcccucagucauagaaaaaauggaagcgcugcaaaggaaauacggaggagcuuuggugaggaauccacucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaauugaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucaucccuggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaauuacggccgaauggcucuggaaagaacuaggaaagaaaaagacaccuagaaugugcacuagagaagaauucucaagaaaagugagaagcaaugcagccuugggggccauauucacugaugagaacaaauggaagucggcacgugaggcuguugaagaugguagauuuugggaacugguugacaaggaaaggauucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuccugaaugaagaucacugguuuuccagagagaacucucugagcggaguggaaggagaagggcugcacaagcuggguuacauucucagagaagugagcaagaaagaaggaggagcaauguacgccgacgacacugcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccgacaccaagaggcacaguaauggauauuauaucgagaagagaccaaagagguaguggacaaguuggcaccuauggccucaacaccuuuaccaauaugggagcccaacuuaucagacagauggagggagaaggagucuuuaaaggcauccagcaccugacagccacagaagaaauugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucguguacucguaguuccauguagaaaccaagaugaacugauugguagagcccgaauuucccagggagccggguggucuuugcgggagacggccugucuggggaagucuuacgcccaaauguggagccugauguacuuccacagacgugaccucaggcuggcggcaaacgcuauuugcucggcagucccaucacauuggguuccaacaagucgaacaaccagguccauacacgccagacaagaauggaugacaacagaagucaugcugacagucuggaacaggguguggauucaagaaaacccauggauggaagacaaaacuccaguggaaucaugggaggaaaucccauacuuggggaaaagagaagaccaauggugcggcucauugauagggcuaacaagcagggccaccugggcaaagaacauccaaacagcaauaaaccaaguuagauccuuaauaggcagugaggaauacacagacuauaugccauccaugaaaagauucagaagagaagaggaagaggcaggggucuugugguag

SEQ ID NO: 6506 - RNA, 9876 nt, Artificial Sequence
  derived and/or modified CDS sequence (wt) from DENV-2__JQ922552__SS-prME
acugcaggcaugaucaucaugcugauuccaacagugauggcguuucauuugaccacacgcaacggagaaccccccaugauugucagcagacaagagaaagggaaaagucucuuguucaaaacagaggauggugugaacaugugugcccucauggccauggaccuuggugaacggugugaagacacaaucacuuauaacuguccucuucucaaucagaaugaaccagaagacauagauuguuggugcaacuccacguccacauggguaacuuaugggacguguaccaccacaggagagcucagaagagaaaaaauaucaguggcgcuuguuccacacgugggaaugggauuggagacacgaacugaaacauggaugucaucagaaggggccuggaaacaugcccagagaauugaaauuuggauucugagacauccaggcuuuaccauaauggccgcaauccuggcauacaccauaggaacgucgcauuuccaaagaguccugauauucaucuuacugacagccaucgcucccucaaugacaaugcgcugcauaggaauaucaaauagggacuuuguggaaggagugucaggagggaguuggguugacauagucuuagaacauggaaguugugugacgacgauggcaaaaaauaaaccaacauuggacuuugaacugauaaaaacagaagccaaacaacccgccacucuaaggaaguacuguauagaggcuaaacugaccaacacgacaacagacucgcgcugcccaacacaaggggaacccacccugaacgaagagcaggacaaaagguuugucugcaaacacuccaugguagacagaggauggggaaauggauguggauuauuuggaaaaggaggcaucgugaccugugcuauguucacaugcaaaaagaucaugaaaggaaaaauugugcagccagaaaacuuggaauacacugucgugauaacaccucacucaggggaagaacaugcagucggaaaugacacaggaaaacaugguaaggaagucaagauaacaccacagagcucuaucacagaggcggaacugacaggcuauggcacuguuacgauggagugcucuccgagaacgggccucgacuucaaugagaugguguugcuccaaauggaagacaaagcuuggcuggugcacagacaaugguuccuagaccuaccgcugccauggcugcccggagcagacacacaaggaucaaauuggauacagaaagagacauuggucacuuucaaaaauccccaugcgaaaaaacaggacguuguugucuuaggaucccaagagggggccaugcauacagcacucacaggggcuacggaaauccagaugucaucaggaaacuugcuguucacaggacaucucaaaugcaggcugagaauggacaaauuacagcuuaaagggaugucauacuccaugugcacaggaaaguuuaaagucgugaaggaaauagcagaaacacaacauggaacaauagucauuagaguacaauaugaaggagacggcucuccaugcaagauccccuuugagauaauggaucuggaaaaaagacauguuuugggccgccugaucacagucaacccaauuguaacagaaaaagacaguccagucaacauagaagcagaaccuccauucggagacagcuacaucaucauaggaguggaaccaggacaauugaagcuuaacugguucaagaaaggaaguuccauuggccaaauguuagagacaacaaugaggggagcgaaaagaauggccauuuugggugacacagccugggauuuuggaucucugggaggaguguucacaucaauaggaaaggcucuccaccagguuuuuggagcaaucuauggggcugcuuucaguggggucucauggacuaugaagauccucacaggaguuaucaucacauggauaggaaugaacucacguagcacaucacugucugugucacuaguauuagugggaaucgugacacuauacuugggaguuauggugcaggccgauagugguugcguugugagcuggaaaaacaaagaacugaaauguggcaguggaauauucgucacagauaacgugcauacauggacagaacaauacauguuccaacccgaauccccuucaaaacuggcuucagccauucagaaagcucaugaagaggguauuuguggaauccgcucaguaacaagacuggaaaaucucauguggaaacagauaacaccagaauugaaucacauucuaucagaaaaugaagugaagcugaccaucaugacaggagacaucaaaggaaucaugcagguaggaaaacgaucucugcggccucaacccacugaguugagguauucauggaaaacauggggccaaccgaaaaugcucuccccagaacuccaccaucagaccuuucucauugauggucccgaaacagcagaaugccccaacacaaacaggacuugggauucauuggaaguugaggacuacggcuuuggaguauucaccaccaaaauauggcuaagauugagagaaaagcaggauguauuuugugacucaaaacucaugucagcggccauaaaggacaacagagccguccaugcugauauggguuauuggauagaaagcgcacucaaugacacauggaagauagagaaagcuucuuucauugaaguuaaaaguugccacuggccaaagucacacacucuauggaguaugggaguacuagaaagcgagaugguaauuccaaagaauuucgcuggaccagugucacaacauaaccacaggccaggcauucccacccaaacagcaggaccuuggcaucuaggcaaacuugagauggacuuugauuucugcgaagggacuacaguggugguaaccgaggacuguggaaacagagggcccucuuuaagaacaaguaccgccucuggaaaacucauaacggaauggugcugucgaucuugcacguuaccaccgcuaagauacagaggugaggauggaugcugguaugggauggaaaucagaccauuaaaagagaaagaagaaaaucuggucaguucucuggucacagccggacaugggcagauugauaauuucucauuaggaaucuugggaauggcauuguuccuugaagaaaugcucaggacucgaguaggaacgaaacaugcaauauuacuagucgcaguuucuuucgugacauuaaucacagggaacaugucuggcagagaccugggaagagugaugguuauggugggugccaccaugacagaugacauagguaugggugugacuuaucucgcucuacuagcagcuuucaaagucagaccaaccuuugcagcuggacugcucuugagaaaacugaccuccaaggaauuaaugaugaccaccauaggaaucguucuucucucccaaaguagcauaccagagaccauucuugaacugacugaugcguuagcuuugggcaugaugguccucaagauggugagaaacauggaaaaauaucagcuggcagugaccaucauggccauuuuaugcgucccaaaugcugugauauuacagaacgcauggaaagugaguugcacaauauuggcauuggugucuguuuccccccuguucuuaacauccucacaacagaaagcggauuggauaccauuagcauugacgaucaaaggucucaauccaacagccauuuuucuaacaacccucucaagaaccagcaagaaaaggagcuggccuuuaaaugaggccaucauggcgguugggauggugagcaucuuggccagcucucucuuaaagaaugacauccccaugacaggaccauuaguggcuggaggucuucuaacugugugcuaugugcuaacugggcggucagccgaucuagaauuagagagagcugccgaugucaaaugggaugaccaggcagagauaucagggagcaguccaauucugucaauaacaauaucagaagauggcagcaugucaauaaagaaugaagaagaagagcaaacacugacuauacucauuagaacagaauugcuggugauaucaggacuuuuucccauaucaauaccaaucacggcagcagcaugguaccugugggaagugaagaaacaacgggcuggaguauugugggauguuccuucacccccaccugugggaaaggccgaacuggaagauggagcuuauagaaucaagcaaaaaggaauucuuggauauucccagaucggagccggaguuuacaaagaaggaacauuucacacaauguggcacgucacacguggcgcuguccuaaugcauaaggggaagaggauugaaccaucaugggcggacgucaagaaagacuuaauaucauauggaggagguuggaagcuagaaggagaauggaaagaaggagaagaaguccagguccuggcauuggagccugggaaaaauccaagagccguccaaacaaagccuggccuuuuuaaaaccaacaccggaaccauaggugccguaucucuggacuuuuccccugggacgucaggaucuccaaucgucgacaaaaaaggaaaaguugugggucucuauggcaauggugucguuacaaggaguggagcauaugugagugccauagcucagacugaaaaaagcauugaagacaauccagagauugaggaugacaucuuucgaagaaagaaguugacuaucauggaucuccacccaggagcaggaaagacaaaaagauaccucccggccauagucagggaggcuauaaaaagaggcuugagaacacuaauccuagcccccacuagagucguggcagccgaaauggaggaagcccuuagaggacuuccaauaagauaccaaaccccagcuaucagggcugagcacaccgggcgggagauuguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaaucuuuaugacagccacuccuccggguagcagagauccauuuccucagaguaaugcaccaauuauggacgaagaaagagaaauuccggaacguucguggaacuccggacaugagugggucacggauuuuaaaggaaagacuguuugguuuguuccaagcauaaaaaccggaaaugacauagcagccugccugagaaagaauggaaagagggugauacaacucaguaggaagaccuuugauucugaauaugucaagacuagaaccaaugacugggauuucguggucacaacugacaucucggaaaugggcgccaacuuuaaagcugagaggguuauagaccccagacgcugcaugaaaccaguuauacugacagacggcgaagagcgggugauucuggcaggacccaugccagugacccacucuagugcagcacaaagaagagggagaauaggaaggaauccaaagaaugaaaaugaucaauauauauauaugggggaacccuuggaaaaugacgaagacugugcgcacuggaaggaagcuaagaugcuccuagauaacaucaacacaccugaaggaaucauuccuagcauguucgagccagagcgugaaaagguggaugccauugacggugaauaucgcuugagaggagaagcaaggaaaacuuuuguggaccuaaugagaagaggagaccuaccagucuggcuggccuacagagggccagccgaaggcauuaacuaugcagacagaaggugguguuuugauggaaucaagaacagccaauucuuggaagaaaauguggaaguggaaaucuggccaucuggaggggaaaggaaggaauugaaacccagaugguuggaugcuaggauauacucugacccacuggcgcuuaaagaauucaaggaguuugcagcuggaagaaaaucccugacccugaauuuaaucacagaaauggguaggcuuccaaccuuuaugacucagaaagcaaggaacgcacuggacaacuuagcaguccugcauacggcugaagcaggcggaagggcguacaaucaugcucucagugaacugccagagacccuggagacauugcuuuugcugacacuuuuggccacagucacggguggaauuuuucuauuccugaugagcggaagggguauagggaagaugacccugggaaugugcugcauaaucacggccagcauccucuuaugguaugcacaaauacaaccacauuggauagcagcuucaauaauauuggaguucuuucucauagucuugcucauuccagaaccagaaaagcaaaggacaccccaggauaaccaauugaccuaugucaucauagccauccucacagugguagccgcaaccauggcaaacgaaauggguuuccuggaaaaaacaaagaaagaucucggacugggaaacauaguaacucagcaaccugagagcaacauucuggacauagaucuacguccugcaucagcauggacguuguaugccgcggcuacaacauuuaucacaccaauguugagacauagcauugaaaauuccucaguaaacaugucccuaacagccauugcuaaccaagccacaguacuaaugggucucgggaaaggauggccauugucaaagauggacauuggaguuccccuccuugcuauuggguguuacucacaagucaacccuauaacccucacagcggcucuuuuuuuauugguagcccauuaugccaucaaaggaccgggacuucaagccaaagcaaccagagaagcucagaaaagagcagcagcgggcaucaugaaaaacccaacuguggauggaauaacagugauagaucuagauccaauacccuaugauccaaaguuugaaaaacaguugggacaaguaaugcucuuaguccucugugugacccaagugcugaugaugaggacuacgugggcuuugugugaagccuuaacucuagcaaccggacccguauccacauugugggaaggaaauccagggagauucuggaacacaaccauugcagugucaauggcaaacaucuuuagagggaguuaccuggcuggaucuagccaggucuggccuuccauuaauaaucuuaagggagguaggagagguacgggagcucaaggggaaacauugggagaaaaauggaaaagacaacuaaaccaacugagcaagucagaauuuaacacuuacaaaaggaguggaauuauggagguggacagaucugaagccaaggagggacugaaaagaggagaaacaaccaaacaugcagugucgagaggaacagccaaacuuaggugguuuguggagaggaaccuugugaaaccagaagggaaagugauagaccucgguugugggagagguggcuggucauauuacugcgccgggcugaagaagguuacagaagugaagggauacacaaaaggaggacccggucaugaggaaccuaucccaauggcgacuuauggauggaaccuagugaagcuacacuccggaaaggauguauucuuuacaccaccagagaagugugacacauuguugugugacauaggggaaucaucaccaaaucccacgguagaagcgggacgaacacucagaguccuuaaccuaguagaaaauuggcugaacaauaacacccaauuuugcauaaagguccuuaacccguacaugcccucagucauugaaaaaauggaaaccuuacaacggaaauacggaggagccuuggugagaaauccacucucacggaauuccacacaugagauguacuggguguccaaugcuuccgggaacauagugucaucagugaacaugauuucaagaaugcugauuaacagauucaccaugagacacaagaaggccacuuaugaaccagaugucgaccucggaagcggaacccgcaauauuggaauugaaagugagacaccgaaccuagacauaauuggaaaaagaauagaaaaaauaaaacaagagcacgaaacgucauggcacuaugaccaagaccacccauacaaaacaugggcuuaccauggcagcuaugaaacaaaacagacuggaucagcaucauccauggugaacggaguagucagacugcugacaaaacccugggacguuguuccaauggugacacagauggcaaugacagacacaacuccuuucggacaacagcgcgucuucaaggagaagguggauacgagaacccaagaaccaaaagaaggcacaaaaaaauuaaugaaaaucacggcagaauggcucuggaaagaacuaggaaagaaaaagacaccuagaaugugccccagagaagaauucacaaaaaaggugagaaguaaugcagccuugggggccauauucaccgaugcgaccaaguggaaaucggcgcgugaggcuguugaagauggcagguuuugggagcugguugacaaggaaaggaaucuccaucuugaagggaaaugugaaacauguguguacaacaugaugggaaaaagagagaaaaaacuaggagaguuuggcaaagcaaaaggcagcagagccauaugguacauguggcuuggagcacgcuucuuagaguuugaagcccuaggauuuuugaaugaagaccauugguucuccagagagaacucccugaguggaguggaaggagaagggcugcacaagcuagguuacaucuuaagagaggugagaaagaaagaaggaggagcaauguaugccgaugacuccgcaggcugggacacaagaaucacacuagaggauuuaaaaaaugaagaaaggauaacgaaccacauggagguagaacacaaaaaacuugccguaggccauuuuauauugacguacccaaacaagguggugcgugugcaaagaccaacaccaguaggcacgguaauggacaucauaucgaggaagagucaaagggguaguggacaaguugguaccuauggccucaauacuuucaccaaccuggaagggccacgaauuaggcaaauggagggggaggaaucuuucaaaagccaucagcuccagacagccacagaaagaaaugcugugcaagauuggcuagcaagaguagggcgugaaagguuaucaagaauggccaucaguggagaugauuguguugugaaaccucuagaugauagauuugcaagagcccuaacagcucuuaaugacaugggaaagguuaggaaggacauacaacaaugggagcccucaagaggauggaacgacuggacacaggugcccuucuguucacaccauuuucacgaguuaauuaugaaagauggucgcacacucguaguuccauguagaaaccaagaugaauugauugguagagcccgaauuucccagggagcuggguggucuuuacgggagacggccugucuggggaagucuuacgcccaaauguggagcuugauguacuuucacagacgugaucucaggcuagcggcaaaugccaucugcucggcagucccgucacacuggguuccaacaagccggacaaccugguccauacacgccagccaugaauggguggcgacggaagacauguugacaguuuggaacagaguguggauccaagaaaauccauggauggaagacaaaacuccaguggaaucaugggaggaaaucccauaccugggaaaaagagaagaccaauggugcggcucacugauugggcugacaagcagagccaccugggcgaagaauauccagacagcaauaaaucaagucagaucccucauuggcaaugaggaauacacagauuacaugccauccaugaaaagauucagaagagaagaggaagaggcaggaguuuugugguag

SEQ ID NO: 6507 - RNA, 9876 nt, Artificial Sequence
  derived and/or modified CDS sequence (wt) from DENV-2__GU131896__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucugcucaggcagaaugagccagaagacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccuaagacauccaggcuucaccauaauggcagcaaucuuggcauacaccauagggacgacacauuuccagagagcccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuauuagauugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccuaggaggaguguuuacaucuguaggaaaagcucuccaccaaaucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaaucccaaagaaucucgcuggaccagugucucaacacaacuauagaccaggcuaccacacacaaacagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacacuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauucuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuucccguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugagcguucauggaauucuggacaugaguggguuacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugacaggguuauagaccccagacgcugcaugaaaccagucauacuaacagauggugaggagcgggugauucuggcaggaccuaugccaguaacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagacaacauuaacacaccagaaggaaucauucccaguauguucgaaccagaacgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauaaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuuugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaacugucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccaucgcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcaucaagagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcacgaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugacgagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaacgaagaaaugguaacaaaccacauggaaggagaacacaaaaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcuauaaaucaaguuagaucucuuauaggcaaugaggaauacacagauuacaugccauccaugaaaagauucagaagagaagaggaagaagcaggaguccugugguaa

SEQ ID NO: 6508 - RNA, 9876 nt, Artificial Sequence
  derived and/or modified CDS sequence (wt) from DENV-2__GU131897__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacacuaccaccccuaagauacagaggugaggaugggugcugguacgggauggaaaucagaccauugaaagagaaagaagaaaaucugauuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuuuuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacagcagcagcaugguaccugugggaagugaagaaacaacgggccggaguauugugggacguuccuucacccccacccaugggaaaggcugaacuggaagauggagccuacagaaucaagcaaaaagggauucuuggauacucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagccggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucauggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguucugugguaa

SEQ ID NO: 6509 - RNA, 9876 nt, Artificial Sequence
  derived and/or modified CDS sequence (wt) from DENV-2__GQ868631__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuaagggagaacauagaagagaaaaaagaucaguggcacucguuccacaugugggaaugggacuggagacgcgaacugaaacauggaugucaucagaaggggcuuggaaacaugcccagagaauugaaacuuggauccuaagacauccaggcuucaccauaauggcggcaauccuggcauacaccauagggacgacacauuuccagagaguccugauuuucauccuacugacagcugucgcuccuucaaugacaaugcgcugcauaggaauaucaaauagagacuuuguagaagggguuucaggaggaaguuggguugacauaguccuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuguuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcacaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuuacucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggaguugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaauugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaagugaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuaggcaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguagacaauuuuucacuaggagucuugggaauggcauuauuccuggaggaaaugcuuaggacccgaguaggaacgaaacaugcaauacuacuaguugcagucucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugauggcuaccauaggaauuguacuccucucccaaagcacuauaccagagaccguucuugaacugacugaugcguuagccuuaggcaugauggcccucaaaauaguaagaaacauggaaaaguaucaauuagcagugacuaucauggcuaucuugugcgucccaaacgcagugauauuacaaaaugcauggaaaguaaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaaacaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacaucaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcaaugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacaguuacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauucaagcagcaauaaaucagguuagaucucuuauaggcaaugaggaauacacagauuacaugccauccaugaaaagauucagaagagaagaggaagaggcaggaguucugugguaa

SEQ ID NO: 6510 - RNA, 9876 nt, Artificial Sequence
  derived and/or modified CDS sequence (wt) from DENV-2__GU131899__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacugcuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacguuggauuucgaacugauaaaaacggaagccaaacagccugccacccuaaggaaguauugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaggagcaugcggucggaaaugacacaggaaaacacggcaaggaaaucaaaguaacaccacagaguuccaucacagaagcagaauugaccgguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuuuaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauacgucuuaggccgccugaucacagucaacccaauuguaacagaaaaagacagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuuuggaucccuaggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagccauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucauucauugagguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagccgggcuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuauuauggcagucggaauggugagcauuuuagccaguucccuccuaaaaaaugauauucccaugacaggaccacuaguggcuggagggcuccucacugugugcuacgugcucacuggacgaucggccgacuuggaacuagagagagcaaccgaugucaaaugggaagaccaggcagagauaucaggaagcaguccaauccugucgauaacaauaucagaagaugguaguaugucgauaaaaaaugaagaggaagaacaaacacugaccauacucauuagaacaggauugcuggugaucucaggacuuuuuccuauaucaauaccagucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacuuuucauacaauguggcaugucacacguggcgcuguucuaaugcacaaaggaaagaggauugaaccuucaugggcggacgucaaaaaagaucuaauaucauauggaggaggcuggaagcuagaaggagaauggaaggaaggagaagaaguccaggugcuggcacuggagccuggaaagaauccaagagccguccaaacaaaaccuggucuuuucaaaaccaacaccggaacaauaggugcuguaucuuuggacuuuuccccuggaacgucaggaucuccaaucaucgacaaaaaaggaaaaguugugggucucuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuauaacuugaucaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaagugauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccauucuagugcagcacaaagaagagggagaauaggaagaaauccaaaaaaugaaaaugaccaguacauauacaugggagaaccucuggaaaaugaugaagacugugcacauuggaaagaagccaaaaugcuccuagauaacauuaacacaccagaaggaaucauuccuaguauguuugaaccagagcgugaaaagguggaugccauugauggcgaauaccguuugagaggagaagcaaggaaaacauuuguggacuuaaugaggagaggagacuuaccagucugguuggcuuacaaaguggcagcugaaggcaucaacuaugcagacagaaggugguguuuugauggaauuaagaacaaccaaauccuggaagaaaauauggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauuuuugaugagcgggaggggcauagggaagaugacccugggaaugugcugcauaaucacggcuagcauacuucuaugguacgcacaaauacagccacauuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggacuaggaagcauugcaacccagcaacccgagagcaacauccuggacauagaccuacgucccgcaucagcuuggacgcuguaugccguggcuacaacauuuguuacaccaaugcugagacauagcauugagaauuccucagugaauguaucccuaacagcuauagccaaccaagcgacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggccaauaucuuuagagggaguuacuuggcuggagcuggacuucucuuuuccauuaugaagaacacaaccaacacaagaaggggaacuggcaacaugggagagacgcuuggagagaaauggaaaagccgauugaacgcacugggaaaaagugaauuccagaucuacaagagaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagcuacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugagacauguguguacaacaugaugggaaaaagagaaaagaagcuaggggaauucggcaaggcaaaagguagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacaugaaaggagaacacaagaaauuggccgaggcuauuuucaaacuaacguaucaaaacaagguggugcgugugcaaagaccaacaccaagaggaacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacagugggaaccuucaaaaggauggaacgauuggacacaagugcccuucuguucacaccauuuccaugagcuaaucaugaaggauggucguguacuuguugucccauguagaaaccaagaugaacugauuggcagagcccgaaucucccaaggagcaggguggucuuugcgggagacggccuguuuggggaagucuuacgcucaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagauauguugacagucuggaacaggguauggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagacuacaugccauccaugaaaagauucagaagagaagaggaagaggcaggaguccugugguaa

SEQ ID NO: 6511 - RNA, 9876 nt, Artificial Sequence
  derived and/or modified CDS sequence (wt) from DENV-2__GU131900__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagauuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgagugggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaagaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauucugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuauucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaaugcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacuuagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaacgacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6512 - RNA, 9876 nt, Artificial Sequence
  derived and/or modified CDS sequence (wt) from DENV-2__GU131901__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauugguuacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggaguuauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcgggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcaggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacguaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacuuucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaacgacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6513 - RNA, 9876 nt, Artificial Sequence
  derived and/or modified CDS sequence (wt) from DENV-2__GU131902__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaggacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuguuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaaaugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaaacucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauagcagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggcacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaauccuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguagaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcagcuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgccucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaagugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6514 - RNA, 9876 nt, Artificial Sequence
  derived and/or modified CDS sequence (wt) from DENV-2__GU131924__SS-prME
ucugcaggcaugaucauuaugcugauuccaacagugauggcguuccaucuaaccacacgcaauggagaaccacacaugaucgucggcauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuuuuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacauggacagguugacaauuuuucacuaggagucuugggaauggcauuauuccuggaggaaaugcuuaggacccgaguaggaacgaaacaugcaauacuacuaguugcaguuucuuuugugacauugaucacagggaauauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacagcagcagcaugguaccugugggaagugaagaagcaacgggccggaguauugugggacguuccuucacccccacccaugggaaaggcugaacuggaagauggagccuacagaaucaagcaaaaagggauucuuggauauucucagauuggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuacgcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaaccugagagcaacauccuggacauagaucuacgucccgcaucagcuuggacgcuguaugccguggcuacaacauucguuacaccaaugcugagacauagcauugagaauuccucagugaauguauccuuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuggcuacagggcccaucuccacacugugggaaggaaauccaggaagguucuggaacacuaccauugcggugucaauggcuaacaucuuuagagggaguuacuuggcuggagcuggacuucucuuuucaauuaagaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcgaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagagaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaauaguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggaguuuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagauaugcugacagucuggaacaggguguggauucgagagaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguucugugguaa

SEQ ID NO: 6515 - RNA, 9876 nt, Artificial Sequence
  derived and/or modified CDS sequence (wt) from DENV-2__GQ868638__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaacugugugaagacacaaucacguacaaguguccucugcucaggcagaaugagccagaagacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccuaagacauccaggcuucaccauaauggcagcaaucuuggcauacaccauagggacgacacauuuccagagagcccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuauuagauugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccuaggaggaguguuuacaucuguaggaaaagcucuccaccaaaucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagccauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaaucccaaagaaucucgcuggaccagugucucaacacaacuauagaccaggcuaccacacacaaacagcuggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacacuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggugccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauucuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguagauuuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagagaucccugagcguucauggaauucuggacaugaguggguuacggauuuuaaagggaagacuguuugguucguuccaagcauaaaagcaggaaaugacauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugacaggguuauagaccccagacgcugcaugaaaccagucauacuaacagauggugaggagcgggugauucuggcaggaccuaugccaguaacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagacaacauuaacacaccagaaggaaucauucccaguauguucgaaccagaacgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauaaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagcgaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuuugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcuaagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcacagaaaagagcagcggcgggcaucaugaaaaauccaacugucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcagugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcauuaagagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuuguauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcacgaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagagcccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugacgagaacaaguggaagucggcacgugaggcuguugaagauaguagguuuugggagcugguugacaaggaaaggaaucuccaucuugaaggaaagugugagacaugcguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaacgaagaaaugguaacaaaccacauggaaggagaacacaaaaaauuagccgaggcuauuuucaaacuaacguaucaaaacaagguggugcgugugcaaagaccaacaccaagaggcacaguaauggacaucauaucgagaagagaccaaagagguagugggcaaguuggcaccuauggacucaauacuuucaccaauauggaagcccaauuaaucagacagauggagggagaaggagucuuuagaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugccuuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuucacaggcgugaccucaggcuggcggcaaaugccauuugcucggcagugccaucacacuggguuccaacaagucgaacaaccugguccauacacgccaaacaugaauggaugacuacggaagacaugcugacagucuggaacaggguguggauucgagaaaauccauggauggaagacaaaaccccaguggaaucaugggaggaaaucccauacuugggaaaaagagaagaccaauggugcggcucauugauugggcuaacaagcagggccacaugggcaaagaacauccaagcagccauaaaucaaguuagaucucuuauaggcaaugaggaauacacagauuacaugccauccaugaaaagauucagaagagaagaggaagaagcaggaguccugugguaa

SEQ ID NO: 6516 - RNA, 9876 nt, Artificial Sequence
  derived and/or modified CDS sequence (wt) from DENV-2__GU131927__SS-prME
ucugcaggcaugaucaucaugcugauuccaacagugauggcguuccaucuaaccacacgcaacggagaaccacacaugaucgucggcauacaggagaaagggaaaagccuucuguucaaaacagaggauggugugaacaugugcacccucauggcuauggaccuuggugaacugugugaagacacaaucacguacaaguguccucuucucaggcagaaugagccagaagacauagacuguuggugcaacuccacgucuacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauucuacugacagcugucgcuccuucaaugacaaugcguugcauaggaauuucaaauagagauuuuguagaagggguuucaggaggaaguuggguugacauagucuuagaacauggaagcugugugacgacgauggcaagaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauagugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaggccucgacuucaaugagaugguguugcuacagauggaaaauaaagcuuggcuggugcauaggcaaugguuccuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuuuacuggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauuuggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguauuuacaucugugggaaaagcucuccaccaagucuuuggagcaaucuauggagcugccuucagugggguuucauggacuaugaaaauccucauaggagucauuaucacauggauaggaaugaacucacgcagcaccucacugucugugucacuaguacugguggguauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaagacgaucuuugcggccucagccuacugagcuaaaguauucauggaaaacaugggguaaagcaaaaaugcucuccacagagucuuauaaccaaaccuuucucauugauggccccgagacgacagagugccccaacgcgaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagccucuuucauugaaguaaaaaacugccacuggccaaaaucacacacccucuggagcaauggagugcuagaaagugagaugauaauuccaaagagucucgcuggaccagugucucaacacaacuauagaccaggcuaccauacacaaauagcaggaccauggcaucuagguaagcuugagauggacuuugacuucugcgauggaaccacagugauagugacugaggacugcggaaauagaggacccucuuugagaacaacuacugccucuggaaaacucauaacagaauggugcugccgauccugcacauuaccaccccuaagauacagaggugaggaugggugcugguacgggauggaaaucagaccauugaaagagaaagaagaaaaucugguuaacuccuuggucacagcuggacaugggcagguugacaauuuuucacugggaguccugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugaccaccauaggaauuguacuccucucccaaagcacuauaccagagaccauucuugaauugacugaugcguuagccuuaggcaugaugguucuuaaaauaguaagaaacauggaaaaguaucaauuagcagugacuaucauggcuaucuugugcgucccaaacgcagugauauuacaaaaugcauggaaagugaguugcacaauacuggcaguggugucuguuuccccacugcuuuugacauccucacagcaaaaaacggauuggauaccauuagcauugacaaucaagggucucaauccaacagccauuuuccuaacaacccucucaagaaccaacaagaaaaggagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaacaggcggagauaucaggaagcaguccaauccugucaauaacaauaucagaagaugguagcaugucgauaaaaaaugaagaggaagaacaaacacugaccauacucauuagaacaggauugcuggugaucucaggacuuuucccuauaucaauaccaaucacggcagcagcaugguaccugugggaagugaagaaacaacgggccggaguauugugggacguuccuucacccccacccaugggaaaagcugaacuggaagauggagcuuauagaaucaagcaaaaagggauucuuggauauucucagaucggagcuggaguuuacaaagaaggaacauuccauacaauguggcaugucacacguggcgcuguucugaugcauaaaggaaagaggauugaaccuucaugggcggacgucaaaaaagaucuaauaucauauggaggaggcuggaaguuagaaggagaauggaaggaaggagaagaaguccaagugcuggcacuggagccuggaaaaaauccaagagccguccaaacaaaaccuggucuuuucaaaaccaauaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugagaaaagcacugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuuuacagacccagcaaguauagcagccagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaucaguacauauacaugggagaaccucuggaaaaugaugaagacugugcacacuggaaagaagccaaaaugcuccuagauaacauuaacacaccagagggaaucauucccaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaccaugcucucagugaacugccggagacccuagagacacugcuuuuacugacacuuuuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaacgaagaaagaucuuggauuaggaagcauugcaacccagcaacccgagagcaacauccuggacauagauuuacgucccgcaucagcuuggacgcuguaugccguggcuacaacauucauuacaccaaugcugagacauagcauugagaauucuucagugaauacaucccuaacagcuauagccaaccaagcaacaguauuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggaccacaugggcucugugugaggccuuaaccuuagcuacagggcccaucuccacacugugggaaggaaauccaggaagguucuggaacacuaccauugcggugucaauggcuaacauuuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaaaagaagugaaaggccuaacaaaaggaggaccaggacacgaagaacccauaccuaugucaacauauggguggaaucuagugcgucuucagaguggaguugacgucuucuucaucccgccagagaagugugacacauuguugugugacauaggggagucaucaccaaaucccacaguggaagcaggaagaacacucagaguccuuaauuuaguagaaaauugguugaacaacaacacucaauuuugcauaaaaguucucaacccauacaugcccucaguuauagaaaaaauggaagcacugcaaaggaaauauggaggagccuuagugagaaacccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccguaauauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaacacaaaccggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacaaagaaacuaaugaaaaucacagcagaguggcuguggaaagaauuagggaagaaaaagacaccuaggaugugcaccagagaagaauuuacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacguguguguacaacaugaugggaaaaagagaaaagaagcugggggaauucggcaaggcaaaaggcagcagagccauaugguacauguggcuuggagcucgcuuccuggaguuugaagcccuaggauuccuaaaugaggaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacaugaaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaacauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcucgaaucucccaaggagcaggguggucuuugcgggagacggccuguuuggggaagucuuacgcccaaauguggagcuugauguauuuccacaggcgugaucucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauuuagaagagaagaggaagaagcaggaguccugugguaa

SEQ ID NO: 6517 - RNA, 9876 nt, Artificial Sequence
  derived and/or modified CDS sequence (wt) from DENV-2__GU131928__SS-prME
ucugcaggcaugaucauuaugcugauuccaacaguaauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggaguugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuaggcaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucgggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagagaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaacaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugauggggaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggaaggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6518 - RNA, 9876 nt, Artificial Sequence
  derived and/or modified CDS sequence (wt) from DENV-2__GU131929__SS-prME
ucugcaggcaugaucauuaugcugauuccaacaguaauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaauucguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggaguugccuuuagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaagcgaucuuugcggccucagcccacugagcuaaaguauucauggaaaacaugggguaaagcaaaaaugcucuucacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuaggcaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucgggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagagaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaacaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugauggggaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggaaggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6519 - RNA, 9876 nt, Artificial Sequence
  derived and/or modified CDS sequence (wt) from DENV-2__GU131930__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacauacaaguguccucugcucaggcagaaugagccagaggacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccugagacauccaggcuucaccauaauggcagcaaucuuggcauacaccauagggacgacacauuuccagagagcccugauuuucauucuauugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacaggggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaguaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagagauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugagaggagcaaagagaauggccauuuugggugacacagccugggacuuuggcucccuaggaggaguguuuacaucuauaggaaaagcucuccaccaagucuuuggagcaaucuauggagcugccuucagugggguuucauggacuaugaaaauccucauaggagucauuauuacauggauaggaaugaacucacgcagcacuucacugucugugucacuaguauuggugggaauugugacucuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccacacacaaacagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcaccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggccucaauccaacagccaucuuucuaacaacccucucaagaaccaacaagaaaaggagcuggccacuaaaugaggccaucauggcagucggaauggugagcauucuagccaguucccuccugaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccgauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucgacacgaguggagaugggugaggcagcugggauuuucaugacagccacucccccgggaaguagagauccauuuccucagagcaaugcaccaaucauagaugaagaaagagaaaucccugagcguucauggaauacuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaacccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaaccuagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaacugucgauggaauaacagugauugaucuagauccaauaccuuaugauccaaaguuugaaaagcaguugggacagguaaugcuacuaauccucugcgugacucaaguauugaugaugaggacuacaugggcucugugugaggccuugaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaacuaacacaagaaggggaacuggcaacauaggagagacgcuuggagagaaauggaaaagccgauugaaugcacugggaaaaagugaauuccagaccuacaagaaaaguggaauccaagaaguggauagaaccuuagcaaaagaaggcaucaagagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaauguaagagaagugaaaggccuaacaaaaggaggaccaggacacgaagaacccaucccuaugucaacauauggguggaaucuagugcgucuccagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaaacaagagcacgaaacaucauggcacuacgaucaagaccacccauacaaaacgugggcauaccaugguagcuaugaaacaaaacagacuggaucagcaucauccauggucaacggaguggucaggcuacuaacaaaaccuugggacguccuucccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaagugagaagcaaugcagccuugggggccauauucacugacgagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagaaggaggagccauguacgccgacgacacagcaggaugggacacaagaaucacacuagaagacuuaaaaaaugaagaaaugguaacaaaccacauggaaggagaacacaaaaaauuagccgaggcuauuuucaaacuaacguaucaaaacaagguggugcgugugcaaagaccaacaccaagaggcacaguaauggacaucauaucgagaagagaccaaagaggcagugggcaaguugguaccuauggacucaauacuuucaccaauauggaagcccaauuaaucagacagauggagggagaaggaguuuuuaaaaacauccagcaccugacagccacagaagaaguugccgugaaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcugcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6520 - RNA, 9876 nt, Artificial Sequence
  derived and/or modified CDS sequence (wt) from DENV-2__GU131931__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcacacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaacaaagcuuggcuggugcauaggcaaugguuucuagaccugccauuaccauggcugcccggagcggauaaacaagagucaaacuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaaaucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucauuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguuguacaauacuggcagugguguccguuuccccacuacuuuugacauccucacagcaaaaaacggauuggauaccauuagcauugacaaucaagggucucaauccaacagccauuuuuuuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggccuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugaacacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauuuacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacgaaccacauggaaggagaacauaagaaauuggccgaggcuauuuucaaacuaacguaucaaaacaagguggugcgugugcagagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6521 - RNA, 9876 nt, Artificial Sequence
  derived and/or modified CDS sequence (wt) from DENV-2__GU131932__SS-prME
ucugcaggcaugaucauuaugcugauuccaacagugauggcguuccaucuaaccacacgcaauggagaaccacacaugaucgucgguauacaggagaaagggaaaagucuucuguuuaaaacagaggauggugugaauaugugcacccucauggcuauggaccuuggugaauugugugaggacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaauuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaaacucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacaacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauacucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacucuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaaaccgauugaacgcacugggaaaaagugaauuccaaaucuacaagaagaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaucucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacaacuccauuuggacagcagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugcuauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguucugugguaa

SEQ ID NO: 6522 - RNA, 9876 nt, Artificial Sequence
  derived and/or modified CDS sequence (wt) from DENV-2__GQ199892__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccuuagacaaaaugaaccagaagacauagauuguuggugcaacucuacguccacauggguaacuuaugggacauguaccaccacgggagaacacagaagagaaaaaagaucaguggcgcucguuccacauguggguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcugucgcuccuucaaugacaaugcgcugcauaggaauaucaaauagagacuucguggaagggguuucaggaggaagcuggguugacaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaacgaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggcaaggaaaucaaaauaacaccacagaguuccaccacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggauacacaaggaucaaauuggauacagaaagagacauuggucacuuucaaaaauccccacgccaagaaacaggaugucguugucuuagggucucaagaaggggccaugcacacggcacucacaggggccacagaaauccagaugucaucaggaaacuuacuguucacgggacaucucaagugcaggcugagaauggacaaacuacagcucaaaggaaugucauacuccauguguacaggaaaguuuaaaaucgugaaggaaauagcagaaacacaacauggaacaauaguuaucagaguacaauaugaaggggacggugcuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagaacaauauaaguuccaaccagaauccccuucaaaacuagcuucagccauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucucauugauggcccugaaacagcagaaugccccaacacaaacagagcuuggaacucacuggaaguugaagacuaugguuuuggaguuuucuccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccacacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggaaucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcauugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacggguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaucuaauaucauauggaggaggcuggaagcuagaaggagaauggaaggaaggagaggaaguccaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuacgguaaugguguugucacaaggaguggagcauacguaagugccauagcccagaccgaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcgggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcauuggacaacuuggcugugcugcauacggcugagguagguggaagggcguacacucaugcucucagugaacugccggagacucuggagacacugcuucuacugacacuccuggcaacagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacaucuuggacauagaucuacguccugcaucagcauggacgcuguaugccguggcuacaacauuugucacaccaaugcugcgacauagcauugaaaauuccucaguaaaugucucccuaacagccauugcuaaccaagcuacagugcuaaugggucuugggaaaggauggccauugucaaagauggacaucggaguuccccuccuugccauuggaugcuacucacaagucaacccuauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagauuuuggaacaccaccauugcagugucaauggcuaacaucuuuagggggagcuacuuggccggagcuggacuucucuuuuccaucaugaagaacacaacaaacacaagaagaggaacuggcaacguaggagagacacuuggagaaaaauggaaaagccgauuaaaugcacuggggaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauacuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugauacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauaauaggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaauggaguggucagacugcugacaaaaccuugggacgucguccccauggugacacagauggcaaugacagauacgacuccauuuggacaacagcgcguuuucaaagagaaaguggacacgagaacucaagaaccgaaggaaggcacaaagaaacugaugaaaauuacggcagaguggcuuuggaaagaacuaggaaaggaaaagacaccuagaauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacauggggaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagagaagaggaagaggcagguguccugugguag

SEQ ID NO: 6523 - RNA, 9876 nt, Artificial Sequence
  derived and/or modified CDS sequence (wt) from DENV-2__JF730044__SS-prME
acagcaggcgugauuauuauguugauuccaacagcgauggcguuccauuuaaccacacgcaauggagaaccacacaugaucguugguagacaagagaaagggaaaagucuucuguucaaaacagaggauggugugaacauguguacccucauggccauagaucuuggugaacugugugaagauacaaucacguacaagugcccccuccucaggcagaaugaaccggaagacauagauuguuggugcaacuccacguccacauggguaacuuaugggacguguaccaccacaggagaacauagaagagaaaaaagaucaguggcacucguuccacauguggguaugggauuggagacacgaacugaaacauggaugucgucagaaggggccuggaaacacguucagagaauugaaaccuggaucuugagacauccaggcuuuaccauaauggcagcaauccuggcauacaccauaggaacgacacauuuccaaagggcccugauuuucaucuuacugacagcuguugcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaagaaccugccacucuaaggaaguacuguauagaagcaaagcugaccaauacaacaacagaaucucguugcccaacacaaggggaacccagucuaaaugaagagcaggacaaaagguucgucugcaaacacuccaugguagacaggggauggggaaauggauguggauuauuuggaaagggaggcauugugaccugugcuauguuuacaugcaaaaagaacauggaaggaaaaaucgugcaaccagaaaauuuggaauacaccauugugauaacaccucacucaggagaagagcacgcuguagguaaugacacaggaaaacaugguaaggaaaucaaaauaacaccacagaguuccagcacagaagcagaacugacaggcuauggcacagucacgauggagugcucuccgagaacgggccuugacuucaaugagauggugcugcugcagauggaagacaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguauuaggaucucaagaaggggccaugcacacggcacucacgggggccacagaaauccagaugucaucaggaaacuuacuauucacaggacaucucaagugcaggcugaggauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacauguuuuaggucgccugauuacaguuaacccgaucguaacagaaaaagauagcccagucaacauagaagcagaaccuccauuuggagacagcuacaucaucauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuaugggaaaggcucuccaccaaguuuucggagcaaucuauggggcugccuuuaguggggucucauggacuaugaaaauccucauaggagucaucaucacauggauaggaaugaauucacguagcaccucacuauccgugucacuaguauuggugggagucauaacacuguacuugggagccauggugcaggcugacagugguugcguugugagcuggaaaaacaaagaacugaaauguggcagcgggaucuucauuacagauaacgugcacacauggacagaacaauacaaguuccaaccagaauccccuucaaaacuagcuucagccauccaaaaagcucaugaagaaggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaucagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguuuugugacucaaaacucaugucagcagccauaaaagacaauagagccguccaugccgauauggguuauuggauagaaagugcacucaaugacacauggaagauggagaaagccucuuucauugaaguuaaaagcugccacuggccaaagucacacacccucuggaguaauggaguauuagaaagugagaugauaauuccaaaaaguuuugcugggccagugucacaacacaacuacagaccaggcuauuacacgcagacagcaggaccuuggcaucuagguaagcuugagauggacuuugauuucugcgaaggaacuacagugguggugacugaagacugcggaaauagaggacccucuuuaagaacaaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuuaggaauggcacuauuccuggaagaaaugcucaggacacgaguaggaacgaaacaugcaauacugcuaguugcaguuucuuuugugacauugauuacugggaacaugucuuuuagagaccugggaagggugauggucauggugggcgcuaccaugacggaugacauaggcaugggagugacuuaucucgcccuacuagcagcuuucaaaguuagaccaacuuuugcagcuggacuacuacugagaaagcugaccuccaaggaauugaugauggcuaccauaggaaucgcacuccuuucucaaagcaccauaccagagaccauucuugaacuaacugaugcguuagccuugggcaugaugguccuuaaaauagugagaaauauggaaaaauaccaauuggcggugacuaucauggccaucucgugugucccaaaugcagugauacugcaaaaugcauggaaggugagcugcacaauauuggcagcgguguccguuucuccacugcucuuaacauccucacagcagaaagcggauuggauaccgcuggcauugacgauaaaaggucucaauccaacagccauuuuucuaacaacucuuucgagaaccagcaagaaaaggagcuggccgcuaaaugaggcuaucauggcagucgggauggugaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucagggaguagcccaauccugucaauaacaauaucagaagauggcagcaugucgauaaaaaaugaagaggaagaacaaacacugaccauacucaucagaacgggauugcuagugaucucaggacucuuuccagugucaauaccaauuacagcagcagcaugguaccugugggaagugaagaaacaacgggcuggaguauugugggacgucccuucacccccacccgugggaaaggccgaacuggaagauggagccuauagaaucaagcaaaaagggauucuuggauauucccagauuggagccggaguuuacaaagaaggaacauuccauacaauguggcacguuacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcacuggaaccuggaaaaaauccaagagcuguccaaacgaaaccuggacuuuucaaaaccaacacaggaaccauaggcgccguaucucuggacuuuuccccuggaacgucaggaucuccaauugucgauagaaaaggaaaaguugugggucuuuauggcaaugguguugucacaaggaguggagcauacgugagugcuauagcccagaccgagaaaagcauugaagacaauccagagaucgaagaugacauuuuccgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguggagaugggugaagcagcugggauuuucaugacagccacuccuccgggaaguagagacccauuuccucagagcaaugcaccaaucauggaugaggaaagagaaaucccugagcguucguggaacucuggacaugaaugggucacggauuuuaaagggaagacuguuugguuuguuccaaguauaaaagcgggaaaugacauagcagccugccucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacgcugcaugaaaccaguuauacuaacagauggcgaagagcgggugaucuuggcaggacccaugccagugacccacucuagugcagcgcaaagaagagggagaauagggagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaaaaccuuuguggaucuaaugagaagaggggacuuaccagucugguuggccuauagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagauggcuggaugcuaggaucuauucugacccacuggcacuaaaagaauuuaaggaauuugcagcuggaagaaaguccuugacccugaacuuaaucacagaaauggguaggcuuccaaccuucaugacucagaaggcaagagaugcacuggauaaccuagcugugcugcauacggcugaggcagguggaagggcguacaaucaugcucucagugaacugccggagacccuggagacacugcuuuuacugacacuccuggcuacagucacgggaggaaucuucuuauucuuaaugagcggaaaagguguagggaagaugacccugggaaugugcugcauaaucacggccagcauccuccuaugguaugcacagauacaaccacacuggauagcagcuucaauaauauuggaguuuuuucucauaguuuugcucauuccagaaccagaaaaacagagaacaccccaagauaaccaacugaccuauguugucauagccauccuuacagugguggccgcaaccauggcgaacgagauggguuuccuggaaaaaaccaagaaagaccuuggauugggaagcauugcaacccaggaaccugagagcaacaucuuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggaugcuacucacaagucaaccccguaacgcucacagcagcucuucuuuuacugguagcacauuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccuaauucucugugugacucaaguauuaaugaugaggacuacaugggcucugugugaggcuuuaaccuuagcgaccgggcccaucuccacauugugggagggcaauccagggagguuuuggaacacuaccauugcagugucaauggccaacaucuucagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaagugaauuucagaucuacaagaaaaguggaauucaggaaguggauagaaccuuagcuaaagaaggcaucaaaagaggagaaacggaccaccacgccgugucgcgaggcucagcaaaacugagaugguucgucgaaagaaacauggucacaccagaagggaaagugguggaccucgguugcggcagagggggcuggucauacuauugugggggacuaaagaauguaaaagaagucaaaggccugacaaaaggaggaccaggacacgaagaacccauccccaugucaacauauggguggaaucuaguacgucugcagaguggaguugauguuuucuucacuccgccagaaaagugugauacauuguugugugacauaggggagucgucaccaaaucccacgauagaagcaggacgaacacuuagaguccucagcuugguggaaaauuggcuaaacaaugacacccaauuuugcauaaagguucucaacccauauaugcccucaguuauagaaaaaauggaaacacugcaaaggaaauauggaggagcccuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagaacaugaaacaucauggcacuaugaccaagaccacccauacaaaacaugggcuuaccauggcagcuaugaaacaaaacagacuggaucagcaucauccauggugaacggaguggucagacugcugacaaaaccuugggacguugucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuuccuggaguuugaagcccugggauucuugaaugaagaucacugguucuccagagagaacucccugaguggaguggaaggagaagggcugcacaagcuaggcuacauucuaagagacgugggcaagaaggaaggaggagcaauguacgccgaugacacagcaggaugggacacaagaaucacacuagaagacuuaaaaaaugaagaaauggugacaaaccacauggaaggagaacacaagaaacuagccgaggccauauuuaaauuaacguaccaaaacaagguggugcgugugcaaagaccaacaccaagagguacaguaauggacaucauaucgagaagagaucaaagaggcagugggcaagucggcaccuauggccuuaacacuuucaccaauauggaagcccaauuaaucagacagauggagggagaaggaauuuuuaaaagcauucagcaccugacagccacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaagucagaaaagacauacaacaaugggaaccuucaagaggauggaaugauuggacacaagugccuuucuguucacaccacuuucaugaguuaaucaugaaagacggucgcgugcucguaguuccaugcagaaaccaagaugaacugauuggcagggcucgaauuucccagggagcuggguggucuuugaaggagacggccugcuuggggaagucuuacgcccaaauguggagccugauguacuuccacagacgugaccucaggcuggcggcaaaugcuauuugcucggcagucccgucacauuggguuccaacaagccgaacaaccuggucuauacacgccaaacaugaauggaugacgacggaagacaugcugacagucuggaacaggguguggauccaagaaaauccauggauggaagacaaaacuccaguggagucaugggaggaagucccauaucugggaaaaagagaagaccaauggugcggcucauugauugggcuaacaagcagggcuaccugggcaaagaauauccaaacagcaauaaaucaagucagaucccuuauaggcaaugaggaauacacagauuacaugccauccaugaagagauucagaagggaagaggaagaggcagguguccugugguag

SEQ ID NO: 6524 - RNA, 9876 nt, Artificial Sequence
  derived and/or modified CDS sequence (wt) from DENV-2__FJ639697__SS-prME
acagcaggcgugauuauuauguugauuccaacagcgauggcguuccauuuaaccacacgcaauggagaaccacacaugaucguugguagacaagagaaagggaaaagucuucuguucaaaacagaggauggugugaacauguguacccucauggccauagaucuuggugaacugugugaagauacaaucacguacaagugcccccuccucaggcagaaugaaccagaagacauagauuguuggugcaacuccacguccacauggguaacuuaugggacguguaccaccacaggagaacauagaagagaaaaaagaucaguggcacucguuccacauguggguaugggauuggagacacgaacugaaacauggaugucgucagaaggggccuggaaacacguucagagaauugaaaccuggaucuugagacauccaggcuuuaccauaauggcagcaauccuggcauacaccauaggaacgacacauuuccaaagggcccugauuuucaucuuacugacagcuguugcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaagaaccugccacucuaaggaaguacuguauagaagcaaagcugaccaauacaacaacagaaucucguugcccaacacaaggggaacccagucuaaaugaagagcaggacaaaagguucgucugcaaacacuccaugguagacaggggauggggaaauggauguggauuauuuggaaagggaggcauugugaccugugcuauguuuacaugcaaaaagaacauggaaggaaaaaucgugcaaccagaaaauuuggaauacaccauugugauaacaccucacucaggagaagagcacgcuguagguaaugacacaggaaaacaugguaaggaaaucaaaauaacaccacagaguuccagcacagaagcagaacugacaggcuauggcacagucacgauggagugcucuccgagaacgggccuugacuucaaugagauggugcugcugcagauggaagacaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguuuuaggaucucaagaaggggccaugcacacggcacucacgggggccacagaaauccagaugucaucaggaaacuuacuauucacaggacaucucaagugcaggcugaggauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacauguuuuaggucgccugauuacaguuaacccgaucguaacagaaaaagauagcccagucaacauagaagcagaaccuccauuuggagacagcuacaucaucauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuaugggaaaggcucuccaccaaguuuucggagcaaucuauggggcugccuuuaguggggucucauggacuaugaaaauccucauaggagucaucaucacauggauaggaaugaauucacguagcaccucacuauccgugucacuaguauuggugggagucauaacacuguacuugggagccauggugcaggcugacagugguugcguugugagcuggaaaaacaaagaacugaaauguggcagcgggaucuucauuacagauaacgugcacacauggacagaacaauacaaguuccaaccagaauccccuucaaaacuagcuucagccauccaaaaagcucaugaagaaggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaucagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguuuugugacucaaaacucaugucagcagccauaaaagacaauagagccguccaugccgauauggguuauuggauagaaagugcacucaaugacacauggaagauggagaaagccucuuucauugaaguuaaaagcugccacuggccaaagucacacacccucuggaguaauggaguauuagaaagugagaugauaauuccaaaaaguuuugcugggccagugucacaacacaacuacagaccaggcuauuacacgcagacagcaggaccuuggcaucuagguaagcuugagauggacuuugauuucugcgaaggaacuacagugguggugacugaagacugcggaaauagaggacccucuuuaagaacaaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuuaggaauggcacuauuccuggaagaaaugcucaggacacgaguaggaacgaaacaugcaauacugcuaguugcaguuucuuuugugacauugauuacugggaacaugucuuuuagagaccugggaagggugauggucauggugggcgcuaccaugacggaugacauaggcaugggagugacuuaucucgcccuauuagcagcuuucaaaguuagaccaacuuuugcagcuggacuacuacugagaaagcugaccuccaaggaauugaugauggcuaccauaggaaucgcacuccuuucucaaagcaccauaccagagaccauucuugaacuaacugaugcguuagccuugggcaugaugguccuuaaaauagugagaaauauggaaaaauaccaguuggcggugacuaucauggccaucucgugugucccaaaugcagugauacugcaaaaugcauggaaggugagcugcacaauauuggcagcgguguccguuucuccacugcucuuaacauccucacagcagaaagcggauuggauaccgcuggcauugacgauaaaaggucucaauccaacagccauuuuucuaacaacucuuucgagaaccagcaagaaaaggagcuggccgcuaaaugaggcuaucauggcagucgggauggugaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucagggaguagcccaauccugucaauaacaauaucagaagauggcagcaugucgauaaaaaaugaagaggaagaacaaacacugaccauacucaucagaacgggauugcuagugaucucaggacucuuuccagugucaauaccaauuacagcagcagcaugguaccugugggaagugaagaaacaacgggcuggaguauugugggacgucccuucacccccacccgugggaaaggccgaacuggaagauggagccuauagaaucaagcaaaaagggauucuuggauauucccagauuggagccggaguuuacaaagaaggaacauuccauacaauguggcacguuacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcacuggaaccuggaaaaaauccaagagcuguccaaacgaaaccuggacuuuucaaaaccaacacuggaaccauaggcgccguaucucuggacuuuuccccuggaacgucaggaucuccaauugucgauagaaaaggaaaaguugugggucuuuauggcaaugguguugucacaaggaguggagcauacgugagugcuauagcccagaccgagaaaagcauugaagacaauccagagaucgaagaugacauuuuccgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaaguauagcagcuagaggauacauuucaacucgaguggagaugggugaagcagcugggauuuucaugacagccacuccuccgggaaguagagacccauuuccucagagcaaugcaccaaucauggaugaggaaagagaaaucccugagcguucguggaacucuggacaugaaugggucacggauuuuaaagggaagacuguuugguuuguuccaaguauaaaagcgggaaaugacauagcagccugccucaggaaaaauggaaagaaagugauacaacucaguaggaagaccuuugacucugaguauguuaagaccaggaccaaugauugggacuuuguggucacaaccgacauuucagaaaugggugccaauuucaaggcugagaggguuauagaccccagacgcugcaugaaaccaguuauacuaacagauggcgaagagcgggugaucuuggcaggacccaugccagugacccacucuagugcagcgcaaagaagagggagaauagggagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccgcuugagaggagaagcaaggaaaaccuuuguggaucuaaugagaagaggggacuuaccagucugguuggccuauagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagauggcuggaugcuaggaucuauucugacccacuggcacuaaaagaauuuaaggaauuugcagcuggaagaaaguccuugacccugaacuuaaucacagaaauggguaggcuuccaaccuucaugacucagaaggcaagagaugcacuggauaaccuagcugugcugcacacggcugaggcagguggaagggcguacaaucaugcucucagugaacugccggagacccuggagacacugcucuuacugacacuccuggcuacagucacgggaggaaucuucuuauucuuaaugagcggaaaagguguagggaagaugacccugggaaugugcugcauaaucacggccagcauccuccuaugguaugcacagauacaaccacacuggauagcagcuucaauaauauuggaguuuuuucucauaguuuugcucauuccagaaccagaaaaacagagaacaccccaagauaaccaacugaccuauguugucauagccauccuuacagugguggccgcaaccauggcgaacgagauggguuuccuggaaaaaaccaagaaagaccuuggauugggaagcauugcaacccaggaaccugagagcaacaucuuggacauagaucuacguccugcgucagcauggacgcuguaugccguggccacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccuugccauuggaugcuacucacaagucaaccccguaacgcucacagcagcucuucuuuuacugguagcacauuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccuaauucucugugugacucaaguauuaaugaugaggacuacaugggcucugugugaggcuuuaaccuuagcgaccgggcccaucuccacauugugggaggguaauccagggagguuuuggaacacuaccauugcagugucaauggccaacaucuucagagggagcuacuuggcuggagcuggacuucuuuuuuccaucaugaagaacacaacaaauacaagaagaggaacuggcaacauaggagagacgcuuggagagaaauggaaaagucgauuaaacgcacugggaaaaagugaauuucagaucuacaagaaaaguggaauucaggaaguggauagaacccuagcuaaagaaggcaucaaaagaggagaaacggaccaccacgccgugucgcgaggcucagcaaaacugagaugguucgucgaaagaaacauggucacaccagaagggaaagugguggaccucgguugcggcagagggggcuggucauacuauugugggggacuaaagaauguaaaagaagucaaaggccugacaaaaggaggaccaggacacgaagaacccauccccaugucaacauauggguggaaucuaguacgucugcagaguggaguugauguuuucuucacuccgccagaaaagugugauacauuguugugugacauaggggagucgucaccaaaucccacgauagaagcaggacgaacacuuagaguccucagcuugguggaaaauuggcuaaauaaugacacccaauuuugcauaaagguucucaacccauauaugcccucaguuauagaaaaaauggaaacacugcaaaggaaauauggaggagcccuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagcuagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacguugucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauuuacaagaaaagugagaagcaaugcagccuugggggccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuuccuggaguuugaagcccugggauucuugaaugaagaucacugguucuccagagagaacucccugaguggaguggaaggagaagggcugcacaagcuaggcuacauucuaagagacgugggcaagaaggaaggaggagcaauguacgccgaugacacagcaggaugggacacaagaaucacacuagaagacuuaaaaaaugaagaaauggugacaaaccacauggaaggagaacacaagaaacuagccgaggccauauuuaaauuaacguaccaaaacaagguggugcgugugcaaagaccaacaccaagagguacaguaauggacaucauaucgagaagagaucaaagaggcagugggcaagucggcaccuauggccuuaacacuuucaccaauauggaagcccaauuaaucagacagauggagggagaaggaauuuuuaaaagcauucagcaccugacagucacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaagucagaaaagacauacaacaaugggaaccuucaagaggauggaaugauuggacacaagugccuuucuguucacaccacuuucaugaguuaaucaugaaagacggucgcgugcucguaguuccaugcagaaaccaagaugaacugauuggcagggcucgaauuucccagggagcuggguggucuuugaaggagacggccugcuuggggaagucuuacgcccaaauguggagccugauguacuuccacagacgugaccucaggcuggcggcaaaugcuauuugcucggcagucccgucacauuggguuccaacaagccgaacaaccuggucuauacacgccaaacaugaauggaugacgacggaagacaugcugacagucuggaacaggguguggauccaagaaaacccauggauggaagacaaaacuccaguggaaucaugggaggaagucccauaucugggaaaaagagaagaccaauggugcggcucauugauugggcuaacaagcaggacuaccugggcaaagaauauucaaacagcaauaaaucaggucagaucccuuauaggcaaugaggaauacacagauuacaugccauccaugaagagauucagaagggaagaggaagaggcagguguccugugguag

SEQ ID NO: 6525 - RNA, 9876 nt, Artificial Sequence
  derived and/or modified CDS sequence (wt) from DENV-2__FJ639698__SS-prME
acagcaggcgugauuauuauguugauuccaacagcgauggcguuccacuuaaccacacguaauggagaaccacacaugaucguugguagacaagagaaagggaaaagucuucuguucaaaacagaggauggugugaacauguguacccucauggccauagaucuuggugaauugugugaagacacaaucacguacaagugcccccuccucaggcagaaugaaccagaagacauagauuguuggugcaacuccacgucuacauggguaacuuaugggacguguaccaccacaggagaacacagaagagaaaaaagaucaguggcacucgucccacauguggguaugggauuggagacacgaacugaaacauggaugucgucagaaggggccuggaaacacgcucagagaauugaaaccuggaucuugagacauccaggcuuuaccauaauggcagcaauccuagcauacaccauaggaacgacacauuuccaaagggcccugauuuucaucuuacugacagcugucgcuccuucaaugacaaugcguuguauaggaauaucaaauagagacuuuguagaagggguuucaggaggaagcuggguugacauagucuuagaacauggaaguugugugacgacaauggcaaaaaacaaaccaacauuggauuuugaauugauaaaaacagaagccaaagaaccugccacucuaagaaaguacuguauagaagcaaagcugaccaauacaacaacagaaucucguugcccaacacaaggggaacccagucuaaaugaagagcaggacaaaagguucguuugcaaacacuccaugguagacaggggauggggaaauggauguggauuauuuggaaaaggaggcauugugaccugugcuauguuuucaugcaaaaagaacauggaaggaaaaaucgugcaaccagaaaauuuggaauacaccaucgugauaacaccucacucaggagaagagcacgcuguagguaaugacacaggaaaacaugguaaggaaaucaaaauaacaccacagaguuccaucacagaagcagaacugacaggcuauggcacagucacgauggagugcucuccgagaacgggccuugacuucaaugagauggugcugcugcagauggaagacaaagcuuggcuggugcacaggcaaugguuccuagaccugccauuaccauggcuacccggagcggacacacaaggaucaaauuggauacagaaagagacauuggucacuuucaaaaauccccacgcgaaaaaacaggaugucguugucuuaggaucucaagaaggggccaugcacacggcacucacaggggccacagaaauccagaugucaucaggaaacuuacuauucacaggacaucucaagugcaggcugagaauggacaaacuacagcucaaaggaaugucauacucuauguguacaggaaaguuuaaaauugugaaggaaauagcugaaacacaacauggaacaauaguuaucagaguacaauaugaaggagacggcucuccauguaagaucccuuuugaaauaauggauuuggaaaaaagacaugucuuaggucgccugauuacaguuaacccgaucauaacagaaaaggauagcccagucaacauagaagcagaaccuccauuuggagacagcuacaucaucauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugccuuuaguggggucucauggacuaugaaaauccucauaggagucaucaucacauggauaggaaugaauucacgcagcaccucacugucugugucacuaguauuggugggagucauaacacuguacuugggagccauggugcaggcugauagugguugcguugugagcuggaaaaacaaagaacugaaauguggcagcgggaucuucauuacagacaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggcccugaaacagcagaaugccccaacacaaacagagcuuggaacucacuggaaguugaagacuaugguuuuggaguuuucaccaccaauauauggcuaaaauugaaagaaaaacaggauguguuuugugacccgaaacucaugucggcagccauaaaagacaauagagccguccaugccgauauggguuauuggauagaaagugcacucaaugacacauggaagauggagaaggccucuuucauugaaguuaaaagcugucacuggccaaagucacacacccucuggaguaauggaguauuagaaagugagaugauaauuccaaaagguuuugcugggccagugucacaacacaacuacagaccaggcuacuacacgcaaacagcaggaccuuggcaucuagguaagcuugagauggacuuugauuucugcgaaggaacuacagugguggugacugaagacugcggaaauagaggacccucuuuaagaacgaccacugccucuggaaaacucauaacagaauggugcugucgauccugcacauuaccaccucuaagauacagaggugaggauggaugcugguaugggauggaaaucagaccauuaaaagagaaagaggagaauuuggucaacuccuuggucacagccggacaugggcagauugacaacuuuucacuaggagucuugggaauggcauuauuccuggaagaaaugcucaggacacgaguaggaacgaaacaugcaauacugcuaguugcaguuucuuuugugacauugauuacugggaacauguccuuuagagaccugggaagagugaugguuauggugggcgcuaccaugacggaugacauagguaugggagugacuuaucucgcccuacuagcagcuuucaaaguuagaccaacuuuuucagcuggacuucuacugagaaagcugaccuccaaggaauuaaugauggcuaccauaggaauugcacuccuuucucaaagcaccauaccagagaccauucuugaacuaacugaugcguuagccuugggcaugaugguccuuaaaauagugagaaacauggaaaaguaccaauuggcagugacuaucauggccaucucgugugucccaaaugcagugauacugcaaaacgcauggaaggugagcugcacaauacuggcagcgguguccguuucuccacugcucuuaacauccucacagcagaaagcggauuggauaccacuggcacugacgauaaaaggucucaauccaacagccauuuuucuaacaacucuuucgagaaccagcaagaaaaggagcuggccgcuaaaugaggcuaucauggcagucgggauggugagcauuuuagccagcucucucuuaaagaaugacauucccaugacagguccauuaguggcuggagggcuucuuacuguguguuaugugcucacuggacgaucggccgauuuggaacuggagagagccaccgaugucaaaugggaagaucaggcagaaauaucaggaagcagcccaauccugucaauaacaauaucagaagauggcagcaugucgauaaaaaaugaagaggaagaacaaacacugaccauacucaucagaacgggauugcuagugaucucaggacucuuuccagugucaauaccaauuacagcagcagcaugguaccugugggaagugaagaaacaacgggcuggaguauugugggacgucccuucacccccacccgugggaaaggccgaacuggaagauggagccuauagaaucaagcaaaaagggauucuuggauauucccagauuggagccggaguuuacaaagaaggaacauuccauacaauguggcacgucacacguggugcuguucugaugcauagagggaagaggauugaaccaucaugggcggacgucaagaaagaccuaauaucauauggaggaggcuggaagcucgaaggagaauggaaggaaggagaggaaguccaaguccuggcacuggaaccuggaaaaaauccaagagcuguccaaacgaaaccuggacuuuucaaaaccaacaccggaaccauaggcgccguaucucuggacuuuuccccuggaacgucaggaucuccaauugucgacagaaaagggaaaguugugggucuuuauggcaauggcguugucacaaggaguggagcauacgugagugcuauagcucagaccgagaaaagcauugaagacaauccagagaucgaagaugacauuuuucgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacacugggcgggagauuguggaccuaaugugucaugccacauuuacuaugaggcugcuaucaccagucagagugccaaauuacaaccugaucaucauggaugaagcucacuucacagacccagcaagcauagcagcuagaggauacauuucaacucgaguagagaugggugaagcagcugggauuuucaugacagccaccccuccgggaaguagagacccauuuccucagagcaaugcaccaaucauggaugaggaaagagagaucccugagcgcucguggaacuccggacaugaaugggucacggauuuuaaagggaagacuguuugguuuguuccaagcauaaaagcgggaaaugacauagcagcuugucucagaaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaagccaguuauacuaacagauggcgaagagcgggugaucuuggcaggacccaugccaguaacccacucuagugcagcgcaaagaagagggagaauaggaagaaauccaaaaaaugaaaaugaucaguacauauacaugggggaaccucuggaaaaugaugaagacugugcacauuggaaagaagcuaaaaugcuccuagauaacaucaauacaccugaaggaaucauuccuaguauguuugaaccagagcgugaaaagguagacgccauugauggugaauaccgcuugagaggagaagcaaggaaaaccuuuguggaccuaaugagaagaggggacuuaccagucugguuggccuacagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagaugguuggaugcuaggaucuauucugacccacuggcacuaaaagaauuuaaggaauuugcagcuggaagaaaguccuugaccuugaaccuaaucacagaaauggguaggcuuccgacuuucaugacucagaaggcaagagacgcacuggauaaccuagcugugcugcauacggcugagguagguggaagggcguacaaucaugcucucagugaacugccggagacccuggagacacuacuuuuacugacacuccuggcuacagucacgggaggaauuuucuuauucuugaugagcggaaaagguguagggaagaugacucugggaaugugcugcauaaucacggccagcauccuccuaugguaugcacagauacaaccacacuggauagcagcuucaauaauauuggaguuuuuucucauaguuuugcucauuccagaaccagaaaaacagagaacaccccaagauaaccaauugaccuacguugucauagccauccucacagugguggccgcaaccauggcaaacgagauggguuuccuggaaaaaaccaagaaagaccuaggauugggaagcauugcaacccaagaaccugagagcaacauccuggacauagaucuacguccugcgucagcauggacgcuguaugccguggcuacaacauuuguuacaccaauguugagacauagcauugaaaauuccucagugaaugugucccuaacagccauugcuaaccaagcuacaguguuaaugggucuugggaaaggauggccauugucaaagauggacaucgggguuccccuccuugccauuggaugcuacucacaagucaaccccauaacucucacagcagcucuucuuuuauugguagcacacuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacaguuaggacaaguaaugcuccuaauucucugcgugacucaaguauuaaugaugaggacuacaugggcucugugugaggcucuaaccuuggcgaccgggcccaucuccacauugugggaaggcaauccagggagguuuuggaacaccacaauugcagugucaauggccaacaucuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaaaugaauuucagaucuacaaaaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacugaagaauguaagagaagucaaaggccugacaaaaggaggaccaggacacgaagaacccauccccaugucaacauauggguggaaucuaguacgucugcagaguggaguugauguuuucuucacuccgccagaaaagugugauacacugcugugugacauaggggagucgucaccaaaucccacgauagaagcaggacguacacucagaguccucagcuugguggaaaauugguugaacaaugacacccaauuuugcauaaagguucucaacccauauaugcccucaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuacgaaacaaaacagacuggaucagcaucauccauggugaacggaguggucagacugcugacaaaaccuugggacguugucccuaugguaacacagauggcaaugacagacacgacuccauuugggcagcagcgcguuuucaaagagaaaguggacacgagaacccaggaaccgaaggaaggcacaaagaaacugaugaaaaucacggcaaaguggcuuuggaaagaacuaggaaagaaaaagacacccagaauauguaccagagaagaauucacaaaaaaagugagaagcaaugcagccuugggggccauauucacugaugagaacaaauggaagucggcacgcgaggcuguugaagauaguagguuuugggagcugguugacaaagaaagaaaucuccaucuugaaggaaagugugaaacauguguguacaacaugaugggaaagagagaaaagaaacuaggggaguucggcaaggcaaaagguagcagagccauaugguacauguggcuuggagcacgcuuccuggaguuugaagcccuaggauucuugaaugaagaucacugguucuccagagagaacucccugaguggaguggaaggagaagggcugcacaagcuaggcuacauucuaagagacgugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauauuuaaauuaacguaccaaaacaagguggugcgugugcaaagaccaacaccaagaggcacaguaauggauaucauaucaagaagagaccaaagaggcagugggcaagucggcaccuauggccucaacacuuucaccaauauggaagcccaauugauuagacagauggagggagaaggaauuuucaaaagcauucagcaccugacagucacagaagaagucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucacgaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccugcuuggggaagucuuacgcccaaauguggagccugauguacuuccacagacgugaccucaggcuggcggcaaaugcuauuugcucggcaguuccgucacauuggguuccaacaagucgaacaaccuggucuauacacgccaaacaugaauggaugacgacggaagacaugcugacagucuggaacaggguguggauccaagaaaacccauggauggaagacaaaacuccaguggagucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaguacacagauuacaugccauccaugaagagauucagaagggaagaggaagaggcagguguccugugguag

SEQ ID NO: 6526 - RNA, 9876 nt, Artificial Sequence
  derived and/or modified CDS sequence (wt) from DENV-2__FJ639699__SS-prME
acagcaggcgugauuauuauguugauuccaacagcgauggcguuccacuuaaccacacguaauggagaaccacacaugaucguugguagacaagagaaagggaaaagucuucuguucaaaacagaggauggugugaacauguguacccucauggccauagaucuuggugaauugugugaagacacaaucacguacaagugcccccuccucaggcagaaugaaccagaagacauagauuguuggugcaacuccacguccacauggguaacuuaugggacguguaccaccacaggagaacacagaagagaaaaaagaucaguggcacucgucccacauguggguaugggauuggagacacgaacugaaacauggaugucgucagaaggggccuggaaacacgcucagagaauugaaaccuggauccugagacauccaggcuuuaccauaauggcagcaauccuggcauacaccauaggaacgacacauuuccaaagggcccugauuuucaucuuacugacagcugucgcuccuucaaugacaaugcguuguauaggaauaucaaauagagacuuuguagaagggguuucaggaggaagcuggguugacauagucuuagaacauggaaguugugugacgacaauggcaaaaaacaaaccaacauuggauuuugaauugauaaaaacagaagccaaagaaccugccacucuaagaaaguacuguauagaagcaaagcugaccaauacaacaacagaaucucguugcccaacacaaggggaacccagucuaaaugaagagcaggacaaaagguucguuugcaaacacuccaugguagacaggggauggggaaauggauguggauuauuuggaaaaggaggcauugugaccugugcuauguuuucaugcaaaaagaacauggaaggaaaaaucgugcaaccagaaaauuuggaauacaccaucgugauaacaccccacucaggagaagagcacgcuguagguaaugacacaggaaaacaugguaaggaaaucaaaauaacaccacagaguuccaucacagaagcagaacugacaggcuauggcacagucacgauggagugcucuccgagaacgggccuugacuucaaugagauggugcugcugcagauggaagacaaagcuuggcuggugcacaggcaaugguuccuagaccugccauuaccauggcuacccggagcggacacacaaggaucaaauuggauacagaaagagacauuggucacuuuuaaaaauccccacgcgaaaaaacaggaugucguugucuuaggaucucaagaaggggccaugcacacggcacucacaggggccacagaaauccagaugucaucaggaaacuuacuauucacaggacaucucaagugcaggcugagaauggacaaacuacagcucaaaggaaugucauacucuauguguacaggaaaguuuaaaauugugaaggaaauagcugaaacacaacauggaacaauaguuaucagaguacaauaugaaggagacggcucuccauguaagaucccuuuugaaauaauggauuuggaaaaaagacaugucuuaggucgccugauuacaguuaacccgaucauaacagaaaaggauagcccagucaacauagaagcagaaccuccauucggagacagcuacaucaucauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugccuuuaguggggucucauggacuaugaaaauccucauaggagucaucaucacauggauaggaaugaauucacgcagcaccucacugucugugucacuaguauuggugggagucauaacacuguacuugggagccauggugcaggcugauagugguugcguugugagcuggaaaaacaaagaacugaaauguggcagcgggaucuucauuacagacaacgugcacacauggacagaacaauacaaguuccaaccagaauccccuucaaaacuagcuucagcuauccaaaaagcucaugaagaggguauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggcccugaaacagcagaaugccccaacacaaacagagcuuggaacucacuggaaguugaagacuaugguuuuggaguuuucaccaccaauauauggcuaaaauugaaagaaaaacaggauguguuuugugacucgaaacucaugucggcagccauaaaagacaauagagccguccaugccgauauggguuauuggauagaaagugcacucaaugacacauggaagauggagaaggccucuuucauugaaguuaaaagcugucacuggccaaagucacacacccucuggaguaauggaguauuagaaagugagaugauaauuccaaaagguuuugcugggccagugucacaacacaacuacagaccaggcuacuacacgcaaacagcaggaccuuggcaucuagguaagcuugagauggacuuugauuucugcgaaggaacuacagugguggugacugaagacugcggaaauagaggacccucuuuaagaacgaccacugccucuggaaaacucauaacagaauggugcugucgauccugcacauuaccaccucuaagauacagaggugaggauggaugcugguaugggauggaaaucagaccauuaaaagagaaagaggagaauuuggucaacuccuuggucacagccggacaugggcagauugacaacuuuucacuaggagucuugggaauggcauuauuccuggaagaaaugcucaggacacgaguaggaacgaaacaugcaauacugcuaguugcaguuucuuuugugacauugauuacugggaacauguccuuuagagaccugggaagagugaugguuauggugggcgcuaccaugacggaugacauagguaugggagugacuuaucucgcccuacuggcagcuuucaaaguuagaccaacuuuugcagcuggacuucuacugagaaagcugacuuccaaggaauuaaugauggcuaccauaggaauugcacuccuuucucaaagcaccauaccagagaccauucuugaacuaacugaugcguuagccuugggcaugaugauccuuaaaauagugagaaacauggaaaaguaccaauuggcagugacuaucauggccaucucgugugucccaaacgcagugauacugcaaaacgcauggaaggugagcugcacaauacuggcagcgguguccguuucuccacugcucuuaacauccucacagcagaaagcggauuggauaccacuggcacugacgauaaaaggccucaauccaacagccauuuuucuaacaacucuuucgagaaccagcaagaaaaggagcuggccgcuaaaugaggcuaucauggcagucgggauggugagcauuuuagccagcucucucuuaaagaaugacauucccaugacagguccauuaguggcuggagggcuccuuacuguguguuaugugcucacuggacgaucggccgauuuggaacuggagagagccaccgaugucaaaugggaagaucaggcagaaauaucaggaagcagcccaauccugucaauaacaauaucagaagauggcagcaugucgauaaaaaaugaagaggaagaacaaacacugaccauacucaucagaacgggauugcuagugaucucaggacucuuuccagugucaauaccaauuacagcagcagcaugguaccugugggaagugaagaaacaacgggcuggaguauuaugggacgucccuucacccccacccgugggaaaggccgaacuggaagauggagccuauagaaucaagcaaaaagggauucuuggauauucccagauuggagccggaguuuacaaagaaggaacauuccauacaauguggcacgucacacguggugcuguucugaugcauagagggaagaggauugaaccaucaugggcggacgucaagaaagaccuaauaucauauggaggaggcuggaagcucgaaggagaauggaaggaaggagaggaaguccaaguccuggcacuggaaccuggaaaaaauccaagagcuguccaaacgaaaccuggacuuuucaaaaccaacaccggaaccauaggcgccguaucucuggacuuuuccccuggaacgucaggaucuccaauugucgacagaaaaggaaaaguugugggucuuuauggcaauggcguugucacaaggaguggagcauacgugagugcuauagcccagaccgagaaaagcauugaagacaauccagagaucgaagaugacauuuuucgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacacugggcgggagaucguggaccuaaugugucaugccacauuuacuaugaggcugcuaucaccagucagagugccaaauuacaaccugaucaucauggaugaagcucacuucacagacccagcaagcauagcagcuagaggauacauuucaacucgaguagagaugggugaagcagcugggauuuucaugacagccaccccuccgggaaguagagacccauuuccucagagcaaugcaccaaucauggaugaggaaagagagaucccugagcgcucguggaacucuggacaugaaugggucacggauuuuaaagggaagacuguuugguuuguuccaagcauaaaagcgggaaaugacauagcagcuugucucagaaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaagccaguuauacuaacagauggcgaagagcgggugaucuuggcaggacccaugccaguaacccacucuagugcagcgcaaagaagagggagaauaggaagaaauccaaaaaaugaaaaugaucaguauauauacaugggggaaccucuggaaaaugaugaagacugugcacauuggaaagaagcuaaaaugcuccuagauaacaucaauacaccugaaggaaucauuccuaguauguuugaaccagagcgugaaaagguagaugccauugauggugaauaccgcuugagaggagaagcaaggaaaaccuuuguggaccuaaugagaagaggggacuuaccagucugguuggccuacagaguggcagcugaaggcaucaacuacgcagacagaaggugguguuuugaugggguuaagaacaaccaaauacuggaagaaaacguggaaguggaaauuuggacaaaagaaggggaaaggaagaaauuaaaacccagaugguuggaugcuaggaucuauucugacccacuggcacuaaaagaauuuaaggaauuugcagcuggaagaaaguccuugaccuugaaccuaaucacagaaauggguaggcuuccgacuuucaugacucagaaggcaagagacgcacuggauaaccuagcugugcugcauacggcugagguagguggaagggcguacaaucaugcucucagugaacugccggagacccuggagacacuacuuuuacugacacuccuggcuacagucacgggaggaauuuucuuauucuugaugagcggaaaagguguagggaagaugacccugggaaugugcugcauaaucacggccagcauccuccuaugguaugcacagauacaaccacacuggauagcagcuucaauaauauuggaguuuuuucucauaguuuugcucauuccagaaccagaaaaacagagaacaccccaagauaaccaauugaccuacguugucauagccauccucacagugguggccgcaaccauggcaaacgagauggguuuccuggaaaaaaccaagaaagaccuaggauugggaagcauugcaacccaagaaccugagagcaacauccuggacauagaucuacguccugcgucagcauggacgcuguaugccguggcuacaacauuuguuacaccaauguugagacauagcauugaaaauuccucagugaaugugucccuaacagccauugcuaaccaagcuacaguguuaaugggucuugggaaaggauggccauugucaaagauggacaucgggguuccccuccuugccauuggaugcuacucacaagucaaccccauaacucucacagcagcucuucuuuuauugguagcacacuaugccauuauagggccaggacuucaagcgaaagcaaccagagaagcucagaaaagagcagcagcagguaucaugaaaaacccaacagucgauggaauaacggugauugaccuagauccaauacccuaugauccaaaauuugaaaaacaguuaggacaaguaaugcuccuaauucucugcgugacucaaguauuaaugaugaggacuacaugggcucugugugaggcucuaaccuuggcgaccgggcccaucuccacauugugggaaggcaauccagggagguuuuggaacaccacaauugcagugucaauggccaacaucuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaaaugaauuucagaucuacaaaaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacugaagaauguaagagaagucaaaggccugacaaaaggaggaccaggacacgaagaacccauccccaugucaacauauggguggaaucuaguacgucugcagaguggaguugauguuuucuucacuccgccagaaaagugugauacacugcugugugacauaggggagucgucaccaaaucccacgauagaagcaggacguacacucagaguccucagcuugguggaaaauugguugaacaaugacacccaauuuugcauaaagguucucaacccauauaugcccucaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuacgaaacaaaacagacuggaucagcaucauccauggugaacggaguggucagacugcugacaaaaccuugggacguugucccuaugguaacacagauggcaaugacagacacgacuccauuugggcagcagcgcguuuucaaagagaaaguggacacgagaacccaggaaccgaaggaaggcacaaagaaacugaugaaaaucacggcaaaguggcuuuggaaagaacuaggaaagaaaaagacacccagaauauguaccagagaagaauucacaaaaaaagugagaagcaaugcagccuuaggggccauauucacugaugagaacaaauggaagucggcacgcgaggcuguugaagauaguagguuuugggagcugguugacaaagaaagaaaucuccaucuugaaggaaagugugaaacauguguguacaacaugaugggaaaaagagaaaagaaacuaggggaguucggcaaggcaaaagguagcagagccauaugguacauguggcuuggagcacgcuuccuggaguuugaagcccuaggauucuugaaugaagaucacugguucuccagagagaacucccugaguggaguggaaggagaagggcugcacaagcuaggcuacauucuaagagacgugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauauuuaaauuaacguaccaaaacaagguggugcgugugcaaagaccaacaccaagaggcacaguaauggauaucauaucaagaagagaccaaagaggcagugggcaagucggcaccuauggccucaacacuuucaccaauauggaagcccaauugauuagacagauggagggagaaggaauuuucaaaagcauucaguaccugacagucacagaagaagucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucacgaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccugcuuggggaagucuuacgcccaaauguggagccugauguacuuccacagacgugaccucaggcuggcggcaaaugcuauuugcucggcaguuccgucacauuggguuccaacaagucgaacaaccuggucuauacacgccaaacaugaauggaugacgacggaagacaugcugacagucuggaacaggguauggauccaagaaaacccauggauggaagacaaaacuccaguggagucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaguacacagauuacaugccauccaugaagagauucagaagggaagaggaagaggcagguguccugugguag

SEQ ID NO: 6527 - RNA, 9876 nt, Artificial Sequence
  derived and/or modified CDS sequence (wt) from DENV-2__FJ639700__SS-prME
acagcaggcgugauuauuauguugauuccaacagcgauggcguuccacuuaaccacacguaauggagaaccacacaugaucguugguagacaagagaaagggaaaagucuucuguucaaaacagaggauggugugaacauguguacccucauggccauagaucuuggugaauugugugaagacacaaucacguacaagugcccccuccucaggcagaaugaaccagaagacauagauuguuggugcaacuccacguccacauggguaacuuaugggacguguaccaccacaggagaacacagaagagaaaaaagaucaguggcacucgucccacauguggguaugggauuggagacacgaacugaaacauggaugucgucagaaggggccuggaaacacgcucagagaauugaaaccuggauccugagacauccaggcuuuaccauaauggcagcaauccuggcauacaccauaggaacgacacauuuccaaagggcccugauuuucaucuuacugacagcugucgcuccuucaaugacaaugcguuguauaggaauaucaaauagagacuuuguagaagggguuucaggaggaagcuggguugacauagucuuagaacauggaaguugugugacgacaauggcaaaaaacaaaccaacauuggauuuugaauugauaaaaacagaagccaaagaaccugccacucuaagaaaguacuguauagaagcaaagcugaccaauacaacaacagaaucucguugcccaacacaaggggaacccagucuaaaugaagagcaggacaaaagguucguuugcaaacacuccaugguagacaggggauggggaaauggauguggauuauuuggaaaaggaggcauugugaccugugcuauguuuucaugcaaaaagaacauggaaggaaaaaucgugcaaccagaaaauuuggaauacaccaucgugauaacaccccacucaggagaagagcacgcuguagguaaugacacaggaaaacaugguaaggaaaucaaaauaacaccacagaguuccaucacagaagcagaacugacaggcuauggcacagucacgauggagugcucuccgagaacgggccuugacuucaaugagauggugcugcugcagauggaagacaaagcuuggcuggugcacaggcaaugguuccuagaccugccauuaccauggcuacccggagcggacacacaaggaucaaauuggauacagaaagagacauuggucacuuuuaaaaauccccacgcgaaaaaacaggacgucguugucuuaggaucucaagaaggggccaugcacacggcacucacaggggccacagaaauccagaugucaucaggaaacuuacuauucacaggacaucucaagugcaggcugagaauggacaaacuacagcucaaaggaaugucauacucuauguguacaggaaaguuuaaaauugugaaggaaauagcugaaacacaacauggaacaauaguuaucagaguacaauaugaaggagacggcucuccauguaagaucccuuuugaaauaauggauuuggaaaaaagacaugucuuaggucgccugauuacaguuaacccgaucauaacagaaaaggauagcccagucaacauagaagcagaaccuccauuuggagacagcuacaucaucauaggaguagagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugccuuuaguggggucucauggacuaugaaaauccucauaggagucaucaucacauggauaggaaugaauucacgcagcaccucacugucugugucacuaguauuggugggagucauaacacuguacuugggagccauggugcaggcugauagugguugcguugugagcuggaaaaacaaagaacugaaauguggcagcgggaucuucauuacagacaacgugcacacauggacagaacaauacaaguuccaaccagaauccccuucaaaacuagcuucagcuauccaaaaagcucaugaagaggguauuuguggaauccgcucaguaacaagauuggagaaucugauguggaaacaaauaacaccagaauugaaucacauucuaucagaaaaugaggcaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaccagaccuuucucauugauggcccugaaacagcagaaugccccaacacaaacagagcuuggaacucacuggaaguugaagacuaugguuuuggaguuuucaccaccaauauauggcuaaaauugaaagaaaaacaggauguguuuugugacucgaaacucaugucggcagccauaaaagacaauagagccguccaugccgauauggguuauuggauagaaagugcacucaaugacacauggaagauggagaaggccucuuucauugaaguuaaaagcugucacuggccaaagucacacacccucuggaguaauggaguauuagaaagugagaugauaauuccaaaagguuuugcugggccagugucacaacacaacuacagaccaggcuaccacacgcaaacagcaggaccuuggcaucuagguaagcuugagauggacuuugauuucugcgaaggaacuacagugguggugacugaagacugcggaaauagaggacccucuuuaagaacgaccacugccucuggaaaacucauaacagaauggugcugucgauccugcacauuaccaccucuaagauacagaggugaggauggaugcugguaugggauggaaaucagaccauuaaaagagaaagaggagaauuuggucaacuccuuggucacagccggacaugggcagauugacaacuuuucacuaggagucuugggaauggcauuauuccuggaagaaaugcucaggacacgaguaggaacgaaacaugcaauacugcuaguugcaguuucuuuugugacauugauuacugggaacauguccuuuagagaccugggaagagugaugguuauggugggcgcuaccaugacggaugacauagguaugggagugacuuaucucgcccuacuggcagcuuucaaaguuagaccaacuuuugcagcuggacuucuacugagaaagcugacuuccaaggaauuaaugauggcuaccauaggaauugcacuccuuucucaaagcaccauaccagagaccauucuugaacuaacugaugcguuagccuugggcaugaugauccuuaaaauagugagaaacauggaaaaguaccaauuggcagugacuaucauggccaucucgugugucccaaacgcagugauacugcaaaacgcauggaaggugagcugcacaauacuggcagcgguguccguuucuccacugcucuuaacauccucacagcagaaagcggauuggauaccacuggcacugacgauaaaaggccucaauccaacagccauuuuucuaacaacucuuucgagaaccagcaagaaaaggagcuggccgcuaaaugaggcuaucauggcagucgggauggugagcauuuuagccagcucucucuuaaagaaugacauucccaugacagguccauuaguggcuggagggcuccuuacuguguguuaugugcucacuggacgaucggccgauuuggaacuggagagagccaccgaugucaaaugggaagaucaggcagaaauaucaggaagcagcccaauccugucaauaacaauaucagaagauggcagcaugucgauaaaaaaugaagaggaagaacaaacacugaccauacucaucagaacgggauugcuagugaucucaggacucuuuccagugucaauaccaauuacagcagcagcaugguaccugugggaagugaagaaacaacgggcuggaguauuaugggacgucccuucacccccacccgugggaaaggccgaacuggaagauggagccuauagaaucaagcaaaaagggauucuuggauauucccagauuggagccggaguuuacaaagaaggaacauuccauacaauguggcacgucacacguggugcuguucugaugcauagagggaagaggauugaaccaucaugggcggacgucaagaaagaccuaauaucauauggaggaggcuggaagcucgaaggagaauggaaggaaggagaggaaguccaaguccuggcacuggaaccuggaaaaaauccaagagcuguccaaacgaaaccuggacuuuucaaaaccaacaccggaaccauaggcgccguaucucuggacuuuuccccuggaacgucaggaucuccaauugucgacagaaaaggaaaaguugugggucuuuauggcaauggcguugucacaaggaguggagcauacgugagugcuauagcccagaccgagaaaagcauugaagacaauccagagaucgaagaugacauuuuucgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacacugggcgggagauuguggaccuaaugugucaugccacauuuacuaugaggcugcuaucaccagucagagugccaaauuacaaccugaucaucauggaugaagcucacuucacagacccagcaagcauagcagcuagaggauacauuucaacucgaguagagaugggugaagcagcugggauuuucaugacagccaccccuccgggaaguagagacccauuuccucagagcaaugcaccaaucauggaugaggaaagagagaucccugagcgcucguggaacucuggacaugaaugggucacggauuuuaaagggaagacuguuugguuuguuccaagcauaaaagcgggaaaugacauagcagcuugucucagaaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacguugcaugaagccaguuauacuaacagauggcgaagagcgggugaucuuggcaggacccaugccaguaacccacucuagugcagcgcaaagaagagggagaauaggaagaaauccaaaaaaugaaaaugaucaguauauauacaugggggaaccucuggaaaaugaugaagacugugcacauuggaaagaagcuaaaaugcuccuagauaacaucaauacaccugaaggaaucauuccuaguauguuugaaccagagcgugaaaagguagaugccauugauggugaauaccgcuugagaggagaagcaaggaaaaccuuuguggaccuaaugagaagaggggacuuaccagucugguuggccuacagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagaugguuggaugcuaggaucuauucugacccacuggcacuaaaagaauuuaaggaauuugcagcuggaagaaaguccuugaccuugaaccuaaucacagaaauggguaggcuuccgacuuucaugacucagaaggcaagagacgcacuggauaaccuagcugugcugcauacggcugagguagguggaagggcguacaaucaugcucucagugaacugccggagacccuggagacacuacuuuuacugacacuccuggcuacagucacgggaggaauuuucuuauucuugaugagcggaaaagguguagggaagaugacccugggaaugugcugcauaaucacggccagcauccuccuaugguaugcacagauacaaccacacuggauagcagcuucaauaauauuggaguuuuuucucauaguuuugcucauuccagaaccagaaaaacagagaacaccccaagauaaccaauugaccuacguugucauagccauccucacagugguggccgcaaccauggcaaacgagauggguuuccuggaaaaaaccaagaaagaccuaggauugggaagcauugcaacccaagaaccugagagcaacauccuggacauagaucuacguccugcgucagcauggacgcuguaugccguggcuacaacauuuguuacaccaauguugagacauagcauugaaaauuccucagugaaugugucccuaacagccauugcuaaccaagcuacaguguuaaugggucuugggaaaggauggccauugucaaagauggacaucgggguuccccuccuugccauuggaugcuacucacaagucaaccccauaacucucacagcagcucuucuuuuauugguagcacacuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacaguuaggacaaguaaugcuccuaauucucugcgugacucaaguauuaaugaugaggacuacaugggcucugugugaggcucuaaccuuggcgaccgggcccaucuccacauugugggaaggcaauccagggagguuuuggaacaccacaauugcagugucaauggccaacaucuuuagagggagcuacuuggcuggagcuggacuucuuuuuuccaucaugaagaacacaacaaauacaagaagaggaacuggcaacauaggagagacgcuuggagagaaauggaaaagccgauuaaacgcacugggaaaaaaugaauuucagaucuacaaaaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaagugguggaccucgguugcggcagagggggcuggucauacuauugugggggacugaagaauguaagagaagucaaaggccugacaaaaggaggaccaggacacgaagaacccauccccaugucaacauauggguggaaucuaguacgucugcagaguggaguugauguuuucuucacuccgccagaaaagugugauacacugcugugugacauaggggagucgucaccaaaucccacgauagaagcaggacguacacucagaguccucagcuugguggaaaauugguugaacaaugacacccaauuuugcauaaagguucucaacccauauaugcccucaguuauagaaaaaauggaaacacugcaaaggaaauauggaggagccuuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuacgaaacaaaacagacuggaucagcaucauccauggugaacggaguggucagacugcugacaaaaccuugggacguugucccuaugguaacacagauggcaaugacagacacgacuccauuugggcagcagcgcguuuucaaagagaaaguggacacgagaacccaggaaccgaaggaaggcacaaagaaacugaugaaaaucacggcaaaguggcuuuggaaagaacuaggaaagaaaaagacacccagaauauguaccagagaagaauucacaaaaaaagugagaagcaaugcagccuuaggggccauauucacugaugagaacaaauggaagucggcacgcgaggcuguugaagauaguagguuuugggagcugguugacaaagaaagaaaucuccaucuugaaggaaagugugaaacauguguguacaacaugaugggaaagagagaaaagaaacuaggggaguucggcaaggcaaaagguagcagagccauaugguacauguggcuuggagcacgcuuccuggaguuugaagcccuaggauucuugaaugaagaucacugguucuccagagagaacucccugaguggaguggaaggagaagggcugcacaagcuaggcuacauucuaagagacgugagcaagaaggaaggaggagcaauguacgccgaugauacagcaggaugggacacaagaaucacacuagaagacuuaaaaaaugaagaaauggugacaaaccacauggaaggagaacacaagaaacuagccgaggccauauuuaaauuaacguaccaaaacaagguggugcgugugcaaagaccaacaccaagaggcacaguaauggauaucauaucaagaaaagaccaaagaggcagugggcaagucggcaccuauggccucaacacuuucaccaauauggaagcccaauugauuagacagauggagggagaaggaauuuucaaaagcauucaguaccugacagucacagaagaagucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaaguuaggaaagacauacaacaaugggaaccuucacgaggauggaacgauuggacacaagugccuuucuguucacaccauuuucaugaguuaaucaugaaagacggucgcgugcucguaguuccaugcagaaaccaagaugaacugauuggcagggcccgaauuucccagggagcuggguggucuuugaaggagacggccugcuuggggaagucuuacgcccaaauguggagccugauguacuuccacagacgugaccucaggcuggcggcaaaugcuauuugcucggcaguuccgucacauuggguuccaacaagucgaacaaccuggucuauacacgccaaacaugaauggaugacgacggaagacaugcugacagucuggaacaggguguggauccaagaaaacccauggauggaagacaaaacuccaguggagucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaguacacagauuacaugccauccaugaagagauucagaagggaagaggaagaggcagguguccugugguag

SEQ ID NO: 6528 - RNA, 9876 nt, Artificial Sequence
  derived and/or modified CDS sequence (wt) from DENV-2__GQ868620__SS-prME
ucugcaggcaugaucauuaugcugauuccaacagugauggcguuccaucuaaccacacguaacggagaaccacacaugaucgucgguauacaggagaaagggaaaagucuucuguucaaaacagaggaugguguaaacaugugcacccucauggcuauggaccuuggugaauugugugaagacacaaucacguacaaguguccucuucucaggcagaaugagccagaagacauagacuguuggugcaacuccacguccacguggguaaccuaugggacuuguaccacuacaggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacacuuccagagagcccugauuuucauccuacugacagcugucgcuccuucaaugacaaugcgcugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguuugucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaagguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccaugguugcccggagcggauaaacaagggucaaauuggauacagaaagaaacauuggucacuuucaaaaauccccaugcuaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuauuagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaacccccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggcucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguauuggugggaauugugacacuguaucugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccacgccgacauggguuacuggauagaaagugcacuaaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaaccacugccucuggaaaacucauaacagaauggugcugccgaucuugcacauuaccaccccuaagauacagaggugaggaugggugcugguacgggauggaaaucagaccauugaaagagaaagaagaaaaucugguuaacucuuuggucacagccggacaugggcagguugacaauuuuucacugggagucuugggaauggcauuguuccuggaggaaaugcuuaggacccgagugggaacgaaacaugcaauacuacuaguugcaguuucuuuugugacauugaucacagggaacauguccuucaaagaccuaggaagaguggugguuaugguaggcgccaccaugacggaugacauagguaugggcgugaccuaucuugcccuacuagcagccuucaaagucagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaucaauuagcagugaccaucauggcuaucuugugcgucccaaacgcagugauauuacaaaaugcauggaaagugaguugcacaauacuggcagugguguccguuuccccacugcuuuugacauccucacagcaaaaaacugauuggauaccauuagcauugacaaucaagggucucaauccaacagccauuuuucugacaacccucucaagaaccaacaagaaaaggagcuggccacuaaaugaggcuaucauggcaguuggaauggugagcauuuuagccagcucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggagguaaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagucguccaaacaaaaccuggucuuuucaaaaccaacaccggaacaauaggugccguaucucuggacuuuuccccuggaacgucaggaucuccaauuauugacaaaaaaggaaaaguugugggccuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgagguuugagaacauuaaucuuggcccccacuagaguuguggcagcugaaauggaggaagcucucagaggacuuccaauaagauaccaaaccccagccauuagagcugagcacacugggcgggaaauuguggaucuaaugugucaugcuacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacagauuuuaaagggaagacuguuugguucguuccaagcauaaaagcaggaaaugauauagcagccugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcggcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugaccuugaaccuaaucacagaaauggguaggcuuccaacauucaugacucagaagacaagagacgcacuggacaaccuagcagugcugcacacggcugaagcagguggaagggcguacaaucaugcucucagugaacuaccggagacccuagagacacugcucuuacugacacuucuggcuacagucacaggagggaucuuuuuauuuuugaugagcgggaggggcauagggaagaugacccugggaaugugcugcauaaucacggcuagcauccuucuaugguacgcacaaauacagccacauuggauagcagcuucaauaauacuggaguuuuuucucauaguuuugcuuauuccagaaccagaaaaacagaggacaccccaagacaaccaauugaccuacgucgucauagccauccucacagugguggccgcaaccauggcaaacgagauggguuuccuagaaaaaacgaagaaagaucuuggauugggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucuccuauugauagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaaugcaaacaacacaagaagaggaacuggcaacauaggagagacgcuuggagagaaauggaaaagccgauugaaugcacugggaaaaagugaauuccagaucuacaagaaaaguggaauccaggaaguggauagaaccuuagcaaaagaaggcaucaaaaggggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguuaugugacauaggggagucaucaccaaaucccacaguggaagcaggacgaacacucagaguccuuaauuuaguagaaaauugguugaacaacgacacucaauuuugcauaaaaguccucaacccauauaugcccucaguuauagaaaaaauggaagcacugcaaaggaaauauggaggagccuuagugagaaauccacucucacggaacuccacacaugagauguacuggguauccaaugcuucuggaaacauagugucaucagugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucaugguacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagauacgacuccauuuggacaacagcguguuuuuaaagaaaaaguggacacgagaacccaagaaccuaaagaaggcacgaagaaauuaaugaaaaucacagcagaguggcuguggaaagaauuagggaagaaaaagacaccuaggaugugcaccagagaagaauucauaagaaaggugagaagcaaugcagccuugggggccauauucacugaugagaacaaguggaagucggcacgugaggcuguugaagauaguagguuuugggaacugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuugaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcagcaaaugccauuugcucggcagugccaucacacuggguuccaacaagucgaacaaccuggucuauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucaaguuagaucucuuauaggcaaugaggaauacacagacuacaugccauccaugaaaagauucagaagagaagaggaagaagcaggaguccugugguaa

SEQ ID NO: 6529 - RNA, 9876 nt, Artificial Sequence
  derived and/or modified CDS sequence (wt) from DENV-2__FJ639702__SS-prME
acagcaggcgugauuauuauguugauuccaacagcaauggcguuccauuuaaccacacgcaauggagaaccacacaugaucguugguagacaagagaaagggaaaagucuucuguucaaaacagaggauggugugaacauguguacccucauggccauagaucuuggugaacugugugaagauacaaucacguacaagugcccccuccucaggcagaaugaaccagaagacauagauuguuggugcaacuccacguccacauggguaacuuaugggacguguaccaccacaggagaacauagaagagaaaaaagaucaguggcacucguuccacauguggguaugggauuggagacacgaacugaaacauggaugucgucagaaggggccuggaaacacguucagagaauugaaaccuggaucuugagacauccaggcuuuaccauaauggcagcaauccuggcauacaccauaggaacgacacauuuccaaagggcccugauuuucaucuuacugacagcuguugcuccuucaaugacaaugcguugcauaggaauaucaaauagagacuuuguagaagggguuucaggaggaagcuggguugacauagucuuagaacauggaaguugugugacgacaauggcaaaaaacaaaccaacauuggauuuugaacugauaaaaacagaagccaaagaaccugccacucuaaggaaguacuguauagaagcaaagcugaccaauacaacaacggaaucucguugcccaacacaaggggaacccagucuaaaugaagagcaggacaaaagguucgucugcaaacacuccaugguagacaggggaugggggaauggauguggauuauuuggaaagggaggcauugugaccugugcuauguuuacaugcaaaaagaacauggaaggaaaaaucgugcaaccagaaaauuuggaauacaccauugugauaacaccucacucaggagaagagcacgcuguagguaaugacacaggaaaacaugguaaggaaaucaaaauaacaccacagaguuccagcacagaagcagaacugacaggcuauggcacagucacgauggagugcucuccgagaacgggccuugacuucaaugagauggugcugcugcagauggaagacaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguauuaggaucucaagaaggggccaugcacacggcacucacgggggccacagaaauccagaugucaucaggaaacuuacuauucacaggacaucucaagugcaggcugaggauggacaaacuacagcucaaaggaaugucauacucuauguguacaggaaaguuuaaaauugugaaggaaauagcagaaacacaacauggaacaauaguuaucagaguacaauaugaaggagacggcucuccauguaagaucccuuuugaaauaauggauuuggaaaaaagacauguuuuaggucgccugauuacaguuaacccgauaguaacagaaaaagauagcccagucaacauagaagcagaaccuccauuuggagacagcuacaucaucauaggaguggagccgggacaauugaaacucaacugguuuaagaaaggaaguuccaucggccaaauguuugagacaacaaugagaggagcgaagagaauggccauuuuaggugacacagccugggauuuuggaucccugggaggaguguuuacaucuaugggaaaggcucuccaccaaguuuucggagcaaucuauggggcugccuuuaguggggucucauggacuaugaaaauccucauaggagucaucaucacauggauaggaaugaauucacguagcaccucacuauccgugucacuaguauuggugggagucauaacacuguacuugggagccauggugcaggcugacagugguugcguugugagcuggaaaaacaaagaacugaaauguggcagcgggaucuucauuacagauaacgugcacacauggacagaacaguacaaguuccaaccagaauccccuucaaaacuagcuucagccauccaaaaagcucaugaagaaggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguauucauggaaaacauggggaaaggcgaaaaugcucuccacagaaucucacaaucagaccuuucucauugauggcccugaaacagcagaaugccccaacacaaacagagcuuggaacucgcuggaaguugaagacuaugguuuuggaguuuucaccaccaauauauggcuaaaauugagagaaaaacaggauguguuuugugacucaaaacucaugucagcagccauaaaagacaauagagccguccaugccgauauggguuauuggauagaaagugcacucaaugacacauggaagauggagaaagccucuuucauugaaguuaaaagcugccacuggccaaagucacacacccucuggaguaauggaguauuagaaagugagaugauaauuccaaaaaguuuugcugggccagugucacaacacaacuacagaccaggcuauuacacgcagacagcaggaccuuggcaucuagguaagcuugagauggacuuugauuucugcgaaggaacuacagugguggugacagaagacugcggaaauagaggacccucuuuaagaacaaccacugccucuggaaaacucauaacagaauggugcugccgauccugcacauuaccaccucuaagauacagaggugaggauggaugcugguaugggauggaaaucagaccauuaaaagagaaagaagagaauuuggucaacuccuuggucacagccggacaugggcagauugacaacuuuucacuaggagucuuaggaauggcacuauuccuggaagaaaugcucaggacacgaguaggaacgaaacaugcaauacugcuaguugcaguuucucuugugacauugauuacugggaacaugucuuuuagagaccugggaagggugauggucauggugggcgcuaccaugacggaugacauaggcaugggagugacuuaucucgcccuacuagcagcuuucaaaguuagaccaacuuuugcagcuggacuacuucugagaaagcugaccuccaaggaauugaugauggcuaccauaggaaucgcacuccuuucucaaagcaccauaccagagaccauucuugaacuaacugaugcguuagccuugggcaugaugguccuuaaaauagugagaaauauggaaaaauaccaauuggcggugacuaucauggccaucucgugugucccaaaugcagugauacugcaaaaugcauggaaggugagcugcacaauauuggcagcgguguccguuucuccacugcucuuaacauccucacagcagaaagcggauuggauaccgcuggcauugacgauaaaaggucucaauccaacagccauuuuucuaacaacucuuucgagaaccagcaagaaaaggagcuggccgcuaaaugaggcuaucauggcagucgggauggugaguauuuuagccaguucucucuuaaagaaugacauucccaugacagguccauuaguggcuggagggcuccuuacuguguguuacgugcucacuggacgaucggccgauuuggaacuggagagagccaccgaugucaaaugggaagaucaggcagaaauaucagggaguagcccaauccugucaauaacaauaucagaagauggcagcaugucgauaaaaaaugaagaggaagaacaaacacugaccauacucaucagaacgggauugcuagugaucucaggacucuuuccagugucaauaccaauuacagcagcagcaugguaccugugggaagugaagaaacaacgggcuggaguauugugggacgucccuucacccccacccgugggaaaggccgaacuggaagauggagccuauagaaucaagcaaaaaggaauucuuggauauucccagauuggagccggaguuuacaaagaaggaacauuccauacaauguggcacguuacacguggcgcuguucugaugcauagagggaagaggauugaaccaucaugggcggacgucaagaaagaccuaauaucauauggaggaggcuggaagcucgaaggagaauggaaggaaggagaggaaguccaaguccuggcacuggaaccuggaaaaaauccaagagcuguccaaacgaaaccuggacuuuucaaaaccaacacaggaaccauaggcgccgugucucuggacuuuuccccuggaacgucaggaucuccaauugucgauagaaaaggaaaaguugugggucuuuauggcaaugguguugucacaaggaguggagcauacgugagugcuauagcccagaccgagaaaagcauugaagacaauccagagaucgaagaugacauuuuccgaaagaaaagauugaccaucauggaccuccauccaggagcgggaaagacaaaaagauaccuuccagccauaguuagagaggccauaaaacguggcuugagaacauuaauccuggcccccacuagagucguggcagcugaaauggaggaagcucuuagaggacuuccaauaagauaccaaaccccagccaucagagccgagcacaccgggcgggagauuguggaccuaaugugucaugccacauuuacuaugaggcugcuaucaccagucagagugccaaauuacaaccugaucaucauggaugaagcucacuucacagacccagcaagcauagcagcuagaggauacauuucaacucgaguggagaugggugaagcagcugggauuuucaugacagccacuccuccgggaaguaaagacccauuuccccagagcaaugcaccaaucauggacgaggaaagagaaauuccugagcguucguggaacucuggacaugaaugggucacggauuuuaaagggaagacuguuugguuuguuccaaguauaaaagcgggaaaugacauagcagccugccucaggaaaaauggaaagaaagugauacaacucaguaggaagaccuuugacucugaguauguuaagacuaggaccaaugauugggacuuuguggucacaaccgacauuucagaaaugggugccaacuucaaggcugagaggguuauagaccccagacgcugcaugaaaccaguuauacuaacagauggcgaagagcgggugaucuuggcaggacccaugccugugacccacucuagugcagcgcaaagaagagggagaauagggagaaauccaaaaaaugaaaaugaccaguacauauacaugggggaaccucuggaaaaugaugaagacugugcacauuggaaagaagcuaaaaugcuccuagacaacaucaacacaccugaaggaaucauuccuaguauguucgaaccagaacgugaaaagguggaugccauugauggugaauaccgcuugagaggagaagcaaggaaaaccuuuguggaucuaaugagaagaggggacuuaccagucugguuggccuauagaguggcagcugaaggcaucaacuacgcagacagaaggugguguuuugauggaguuaagaacaaccaaauacuggaagaaaacguggaaguggaaauuuggacaaaagaaggggaaaggaagaaauuaaaacccagauggcuggaugcuaggaucuauucugacccacuggcacuaaaagaauuuaaggaauuugcagcuggaagaaaguccuugacccugaacuuaaucacagaaauggguaggcuuccaaccuucaugacucagaaggcaagagaugcacuggauaaccuagcugugcugcauacggcugaggcagguggaagggcguacaaucaugcucucagugaacugccggagacccuggagacacugcuuuuacugacacuccuggcuacagucacgggaggagucuucuuauucuuaaugaguggaaaagguguagggaagaugacccugggaaugugcugcauaaucacggccagcauccuccuaugguaugcacagauacaaccacacuggauagcagcuucaauaauauuggaguuuuuucucauaguuuugcucauuccagaaccagaaaaacagagaacaccccaagauaaccaacugaccuauguugucauagccauccuuacagugguggccgcaaccauggcgaacgagauggguuuccuggaaaaaaccaagaaagaccuuggguugggaagcauugcaacccaggaaccugagagcaacaucuuggacauagaucuacguccugcgucagcauggacgcuguaugccguggcuacaacauuugucacaccaauguugagacauagcauugaaaauuccucagugaaugugucccuaacagccauugcuaaccaagccacagugcuaaugggucuugggaaaggauggccauugucaaagauggacaucggaguuccccuccucgccauuggaugcuacucacaagucaaccccguaacgcucacagcagcucuucuuuuacugguagcacauuaugccauuauagggccaggacuucaagcgaaagcaaccagagaagcucagaaaagagcagcagcaggcaucaugaaaaacccaacagucgauggaauaacagugauugaccuagauccaauacccuaugauccaaaauuugaaaaacagcuaggacaaguaaugcuccuaauccucugugugacucaaguauuaaugaugaggacuacaugggcucugugugaggcuuuaaccuuagcgaccgggcccaucuccacauuaugggagggcaauccagggagguuuuggaacacuaccauugcagugucaauggccaacaucuucagagggagcuacuuggcuggagcuggacuucuuuuuuccaucaugaagaacacaacaaauacaagaagaggaacuggcaacauaggagagacacuuggagagaaauggaaaagucgauuaaacgcacugggaaaaagugaauuucagaucuacaagaaaaguggaauucaggaaguggauagaaccuuagcuaaagaaggcaucaaaagaggagaaacggaccaccacgccgugucgcgaggcucagcaaaacugagaugguucgucgaaagaaacauggucacaccagaagggaaagugguggaccucgguugcgguagagggggcuggucauacuauugugggggacuaaagaauguaaaagaagucaaaggccugacaaaaggaggaccaggacacgaagaacccauccccaugucaacauauggguggaaucuaguacgucugcagaguggaguugauguuuucuucacuccgccagaaaagugugauacauuguugugugacauaggggagucgucaccaaaucccacgauagaagcaggacgaacacuuagaguccucagcuugguggaaaauuggcuaaacaaugacacccaauucugcauaaagguucucaacccauauaugcccucaguuauagaaaaaauggaaacacugcaaaggaaauauggaggagcccuagugaggaauccacucucacgaaacuccacacaugagauguacuggguauccaaugcuacugggaacauagugucaucagugaacaugauuucaaggaugcugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacaugggcuuaccauggcagcuaugaaacaaaacagacuggaucagcaucauccauggugaacggaguggucagacugcugacaaaaccuugggacguugucccuaugguaacacagauggcaaugacagacacgacuccauuuggacaacagcgcguuuucaaagagaaaguggacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaaugcagccuugggggccauauucacugaugagaacaaauggaagucggcacgcgaggcuguugaagauaguagguuuugggagcugguugacaaggaaagaaaucuccaucuugaaggaaagugugaaacauguguguacaacaugaugggaaagagagaaaagaaacuaggggaguucggcaaggcaaaagguagcagagccauaugguacauguggcuuggagcacgcuuccuggaguuugaagcccugggauucuugaaugaagaucacugguucuccagagagaacucccugaguggaguggaaggagaagggcugcacaagcuaggcuacauucuaagagacgugggcaagaaggaaggaggagcaauguacgccgaugacacagcaggaugggacacaagaaucacacuagaagacuuaaaaaaugaagaaauggugacaaaccacauggaaggagaacacaagaaacuagccgaggccauauuuaaauuaacguaccaaaacaagguggugcgugugcaaagaccaacaccaagagguacaguaauggacaucauaucgagaagagaucaaagaggcagugggcaagucggcaccuauggccuuaacacuuucaccaauauggaagcccaauuaaucagacagauggagggagaaggaauuuuuaaaagcauucagcaccugacagccacagaagaaaucgcuguacagaacugguuagcaagaguggggcgugaaaggcuaucaagaauggccaucaguggagaugauuguguuguaaaaccuuuagaugacagauuugcaagugcuuuaacagcucuaaaugacaugggaaaagucagaaaagacauacaacaaugggaaccuucaagaggauggaaugauuggacacaagugccuuucuguucacaccacuuucaugaguuaaucaugaaagacggucgcgugcucguaguuccaugcagaaaccaagaugaacugauuggcagggcucgaauuucccagggagcuggguggucuuugaaggagacggccugcuuggggaagucuuacgcccaaauguggagccugauguacuuccacagacgugaccucaggcuggcggcaaaugcuauuugcucggcagucccgucacauuggguuccaacaagccgaacaaccuggucuauacacgccaaacaugaauggaugacgacggaagacaugcugacagucuggaacaggguguggauccaagaaaauccauggauggaagacaaaacuccaguggagucaugggaggaagucccauaucugggaaaaagagaagaccaauggugcggcucauugauugggcuaacaagcagggcuaccugggcaaagaauauccaaacagcaauaaaucaagucagaucccuuauaggcaaugaggaauacacagauuacaugccauccaugaagagauucagaagggaagaggaagaggcagguguccugugguag

SEQ ID NO: 6530 - RNA, 9876 nt, Artificial Sequence
  derived and/or modified CDS sequence (wt) from DENV-2__GQ868621__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaacugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguucugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauauaucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcgucagcuauccagaaggcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaacugaaagaaaaacaggacgcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuuaugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacacacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacugacccagcaagcauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacugacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacaucaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcggccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauuaaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugagaacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagcccuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuggguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggggaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugaguuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6531 - RNA, 9876 nt, Artificial Sequence
  derived and/or modified CDS sequence (wt) from DENV-2__FJ639704__SS-prME
ucugcaggcaugaucauuaugcugauuccaacagugguggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagcuacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccuaggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagccuacugagcuaaaguauucauggaaaacaugggguaaaacaaaaaugcucuccacagagucuuauaaccaaaccuuucucauugauggccccgagacgacagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaccugguuaacuccuuggucacagccggacaugggcagguugacaauuuuucacugggaguccugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugaccaccauaggaauuguacuccucucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaagcggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacuaguagcuggagggcuccucacugugugcuacgugcucacuggacgaucggccgauuuggaacuggagagagcaaccgaugucaaaugggaagaacaggcagagauaucaggaagcaguccaauccugucaauaacaauaucagaagaugguagcaugucgauaaaaaaugaagaggaagaacaaacacugaccauacucauuagaacaggauugcuggugaucucaggacuuuucccuauaucaauaccaaucacggcagcagcaugguaccugugggaagugaagaaacaacgggcuggaguauugugggacguuccuucacccccacccaugggaaaagcugagcuggaagauggagccuauagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaagaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuuuacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggagccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaucaguacauauacaugggagaaccucuggaaaaugaugaagacugugcacacuggaaagaagccaaaaugcuccuagacaacauuaacacaccagagggaaucauucccaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuccuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaacgaagaaagaucuuggauuaggaagcauugcaacccagcaacccgagagcaacauccuggacauagaucuacgucccgcaucagcuuggacgcuguaugccguggcuacaacauucauuacaccaaugcugagacauagcauugagaauucuucagugaauauaucccuaacagcuauagccaaccaagcaacaguauuaaugggucuagggaaaggauggccauugucaaagauggacaucggaguuccccuucucgccauuggauguuacucacaagucaaucccauaacucucacagcagcucuucucuuauugguagcgcacuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacauuuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaaaagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggaagaacacucagaguccuuaauuuaguagaaaacugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacaaacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacguguguguacaacaugaugggaaagagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauuuagaagagaagaggaagaagcaggaguccugugguaa

SEQ ID NO: 6532 - RNA, 9876 nt, Artificial Sequence
  derived and/or modified CDS sequence (wt) from DENV-2__GQ868622__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggacuuguacuacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagcuagacagccugccacccuaaggaaguauugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccccacucaggggaagagcaugcggucggaaaugacacagggaaacauggcaaggaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauauguccuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccaucuugggugacacagccugggacuucggcucccuaggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguacuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugccccaacacaaauagagcuuggaacucguuggagguugaagacuacggcuucggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucucgcccuacuagcagccuucaaaguuagaccaacuuuugcagcuggacuacucuugagaaagcugaccuccaaggaauugaugaugacuaccauaggaauugugcuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauuuuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcgguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccgugucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccuuuggaaaaugaugaagacugugcacacuggaaagaagccaaaaugcuccuagacaacauuaacacaccggaaggaaucauucccaguauguuugaaccagagcgugaaaaaguggaugccauugauggcgaauaccgcuugagaggagaagcaaggaaaaccuuuguggacuuaaugaggaggggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuaugguacgcacagauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagaguaacauccuggacauagaucuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauacggguggaaucuagugcgucuccagagcggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaauaugauuucaaggauguugaucaacagauucacaaugagacacaagaaagccacuuacgagccggauguugaccucggaagcggaacccgcaacauuggaauugaaagugaaauaccaaaccuagacauaauugggaaaagaauagaaaaaauaaagcaagagcaugaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugacgagaauaaguggaagucggcacgugaggcuguugaagauagaagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6533 - RNA, 9876 nt, Artificial Sequence
  derived and/or modified CDS sequence (wt) from DENV-2__FJ639705__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagcuagacagccugccacccuaaggaaguauugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacauggcaaggaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauauguccuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugauacagccugggacuucggcucccuaggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugccccaacacaaauagagcuuggaacucguuggagguugaagacuacggcuucggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucucgcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauuuuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcgguucuaaugcauaaaggaaagaggauugaaccuucaugggcggaugucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccgugucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccuuuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuagaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagaguaacauccuggacauagaucuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucucauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauacggguggaaucuagugcgucuccagagcggaguugacgucuucuucaucccgccagaaaagugugacacauuguugugugacauaggggagucaucaccaaaucccacaguggaagcaggacgaacacucagaguccuuaacuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccgcaacauuggaauugaaagugaaauaccaaaccuagacauaauugggaaaagaauagaaaaaauaaagcaagagcaugaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuggggaagaaaaagacaccuaggaugugcaccagagaagaauucacaagaaaggugagaagcaaugcagccuugggggccauauucacugacgagaauaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6534 - RNA, 9876 nt, Artificial Sequence
  derived and/or modified CDS sequence (wt) from DENV-2__FJ639706__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggacuuguacuacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaagaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccuaggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaauguggcagcgggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgacggaaccacagugauagugaccgaggacugcggaaauagaggacccucuuugagaacaaccacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacucuugagaaagcugaccuccaaggaauugaugaugaccaccauaggaauugcacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccgucuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauuuuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauucugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaacuaaugauugggauuucgugguuacaacugacauuucagaaaugggugccaauuucaaagcugagaggguuauagaccccagacgcugcaugaaaccagucauacuaacagauggugaggagcgggugauucuagcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaaucaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagagcggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugacgagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaaaagaccaaagagguagugggcaaguugguaccuauggacucaauacuuucaccaauauggaagcccaauuaaucagacagauggagggagaaggagucuucaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugauaugggaaagauuagaaaagauauacaacaaugggaaccuucaaaaggauggaacgauuggacacaagugcccuucuguucacaccauuuccaugagcuaaucaugaaggauggucguguacucguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaccaaguuagaucucuuauaggcaaugaggaauacacagauuacaugccauccaugaaaagauucagaagagaagaggaagaagcaggaguccugugguaa

SEQ ID NO: 6535 - RNA, 9876 nt, Artificial Sequence
  derived and/or modified CDS sequence (wt) from DENV-2__FJ639707__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauauaucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacguagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacauggggaaaagcaaaaaugcucuccacagagucuuauaaccaaaccuuucucauugauggccccgagacgacagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuuuauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuagaggaaaugcuuaggacccgaguaggaacgaaacaugcaauauuacuaguugcaguuucuuuuaugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugaccaccauaggaauuguacuccucucccaaagcacuauaccagagaccguucuugaauugacugaugcguuagccuuaggcaugaugguccuuaaaauaguaagaaacauggaaaaguaucaacuagcagugacgaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuagcggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaagaagaacaaacacugaccauacucauuagaacaggauugcuggugaucucaggacuuuuuccuauaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaagcauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugccaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacaucaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggauucuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauugggaagcauugcaacccagcaacccgagagcaacauccuggacauagaucuacgucccgcaucagcuuggacgcuguaugccguggcuacaacauucguuacaccaaugcugagacauaguauugagaauuccucagugaauguaucccuaacagcuauagccaaccaagcaacaguguuagugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauagcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagcccuagugagaaauccacucucacggaacuccacacaugagauguacuggguauccaaugcuucugggaacauagugucaucagugaacaugauuucaaggauguugaucaauagauuuacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaauggaguggucaggcugcugacaaaaccuugggacguccuccccacggugacacagauggcaaugacagacacgacuccauuuggacaacagcguguuuuuaaagaaaaaguagacacgagaacccaagaaccgaaagaagguacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgacuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6536 - RNA, 9876 nt, Artificial Sequence
  derived and/or modified CDS sequence (wt) from DENV-2__FJ639708__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauauaucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacauggggaaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuuaugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaagcauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacaucaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcuuggacgcuguaugccguggcuacaacauucguuacaccaaugcugagacauaguauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagcccuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaauggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6537 - RNA, 9876 nt, Artificial Sequence
  derived and/or modified CDS sequence (wt) from DENV-2__FJ639709__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggacuuguacuacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaagaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcuacccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccuaggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacggugauagugaccgaggauugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccgacuuuugcagcuggacuacucuugagaaagcugaccuccaaggaauugaugaugacuaccauaggaauuguacuccucucccaaaccacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauuuuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucaccuccacccaugggaaaggcugaacuggaagauggagccuauagaaucaagcaaaaagggauucuuggauauucucagaucggagcuggaguuuacaaagaaggaacauuccauacaauguggcaugucacacguggcgcuguucuaaugcacaaaggaaagaggauugaaccuucaugggcggacgucaaaaaagaucuaauaucauauggaggaggcuggaaguuagaaggagaauggaaggaaggagaagagguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagagggucauagaccccagacgcugcaugaaaccagucauacuaacagauggugaggagcgggugauucuggcaggaccuaugccagugacccacucuagugcagcgcaaagaagagggagaauaggaagaaauccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggacgccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaaaacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuauggaacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaaccgucgauggaauaacagugauugauuuagauccaauaccuuaugauccaaaguuugaaaagcaguugggacaaguaaugcuacuaauccucugcgugacucaaguauugaugaugaggacuacaugggcucugugugaggccuuaacuuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaucucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagagcggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugacgagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcacuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccugcuuggggaagucuuacgcccaaauguggagccugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6538 - RNA, 9876 nt, Artificial Sequence
  derived and/or modified CDS sequence (wt) from DENV-2__FJ639710__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacacagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggagccauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccaagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacacuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucauuauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaauacuggugggaauugugacacuguauuugggagucauggugcaggccgauaguggcugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaagacgaucuuugcggccucagccuacugagcuaaaguauucauggaaaacauggggaaaagcaaaaaugcucuccacagagucuuauaaccaaacuuuucucauugauggccccgaaacgacagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggauggaugcugguacgggauggaaaucagaccauugaaagagaaagaagaaaaucugguuaacuccuuggucacagcuggacaugggcagguugacaauuuuucacugggaguccugggaauggcauuguuccuggaggaaaugcuuaggacccgaguaggaacgaaacaugcaauacuacuaguugcaguuucuuuugugacauugaucacagggaacauguccuucaaagaccuaggaagagugguaguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugaccaccauaggaauuguacuccucucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaagaaugauauucccaugacaggaccacuaguggcuggagggcuccucacugugugcuacgugcucacuggacgaucggccgacuuggaacuggagagagcaaccgaugucaaaugggaagaacaggcagagauaucaggaagcaguccaauccugucaauaacaauaucagaagaugguagcaugucgauaaaaaaugaagaggaagaacaaacacugaccauacucauuagaacaggauugcuggugaucucaggacuuuucccuauaucaauaccaaucacggcagcagcaugguaccugugggaagugaagaaacaacgggccggaguauugugggacguuccuucacccccacccaugggaaaagcugaacuggaagauggagccuauagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuuuacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggaucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaucaguacauauacaugggugaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccguuugagaggagaagcaaggaaaaccuuuguggaccuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccuaggaaugugcugcauaaucacggccagcauccuucuaugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaacgaagaaagaucuuggauuaggaagcauugcaacccagcaacccgagagcaacauccuggacauagaucuacgucccgcaucagcuuggacgcuguaugccguggcuacaacauucauuacaccaaugcugagacauagcauugagaauucuucagugaauacaucccuaacagcuauagccaaccaagcaacaguauuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccauuuccacacugugggaaggaaauccaggaagguuuuggaacacuaccauugcggugucaauggcuaacauuuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaaaagaagugaaaggccuaacaaaaggaggaccaggacacgaagaacccaucccuaugucaacauauggguggaaucuagugcgucuucagaguggaguugaugucuucuucaucccgccagagaagugugacacauuguugugugacauaggggagucaucaccaaaucccacaguggaagcaggaagaacacucagaguccuuaauuuaguagaaaauugguugaacaacaacacucaauuuugcauaaaaguucucaacccauacaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaacagauucacaaugagacacaagaaagccaccuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccauccauacaaaacgugggcauaccaugguagcuaugaaacaaaacaaacuggaucagcaucauccauggucaacggaguggucaggcugcugacaaaaccuugggacguccuucccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacguguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgauacagcaggaugggacacaagaaucacacuagaagaccuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaauuagacagauggagggagaaggagucuuuaaaaacauccagcaccugacagucacagaagaaguugccgugcagaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggagccuucaaaaggauggaacgauuggacacaagugcccuucuguucacaccauuuccaugagcugaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauauauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggcuacaugggcaaagaacauccaagcagcaauaaaucagguuagaucucuuauaggcaaugaggaauacacagauuacaugccauccaugaaaagauuuagaagagaagaggaagaagcaggaguccugugguaa

SEQ ID NO: 6539 - RNA, 9876 nt, Artificial Sequence
  derived and/or modified CDS sequence (wt) from DENV-2__GQ868623__SS-prME
ucugcaggcaugaucauuaugcugauuccaacggugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggacuuguacuacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaagaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcuacccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccuaggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcgaaaaugcucuccacagagucucauaaccaaaccuuucucauugauggccccgagacggcagaaugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggacuggcauuguuccuggaggaaaugcuuaggacccgaguaggaacgaaacaugcaauacuacuaguugcaguuucuuuugugacauugaucacagggaacauguccgucaaagaccuaggaagaguagugguuaugguaggcgccaccaugacggaugacauagguaugggcgugacuuaucuugcccuacuagcagccuucaaaguuagaccgacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggucucaauccaacagccaucuuucuaacaacccucucaagaaccaacaagaaaaggagcuggccacuaaaugaggccaucauggcagucggaauggugagcauuuuagccaguucccuccugaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccugggaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagcuaucagagcugagcacacugggcgggaaauuguggauuugaugugucaugccacauuuaccaugaggcugcuaucaccaguuagagugccaaacuauaacuugauuaucauggacgaagcccauuucacagacccagcaaguauagcagcuagaggauauaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagagggucauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaccaacuaugcagacagaaggugguguuuugauggaauuaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagcuggaagaaagucucugacccugaaccuaaucacagaaauggguaggcuuccaacauucaugacucagaaaacaagagacgcacuggacaaccuagcagugcugcacacggcugaagcagguggaagggcguacaaucaugcucucagugaacugccggagacccuagagacacugcucuuacugacacuccuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaaccgucgauggaauaacagugauugauuuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacauuuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaccuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagagcggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaacauggaggagccuuagugagaaauccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaucaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugacgagaacaaguggaagucggcacgugaggcuguugaagauaguagguuuugggagcugguugacagggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcacuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauugaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccugcuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6540 - RNA, 9876 nt, Artificial Sequence
  derived and/or modified CDS sequence (wt) from DENV-2__GQ868624__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6541 - RNA, 9876 nt, Artificial Sequence
  derived and/or modified CDS sequence (wt) from DENV-2__FJ639717__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacauacaaguguccucugcucaggcagaaugagccagaggacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccugagacauccaggcuucaccauaauggcagcaaucuuggcauacaccauagggacgacacauuuccagagagcccugauuuucauucuauugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacaggggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaguaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggagcaaagagaauggccauuuugggugacacagccugggacuuuggcucccuaggaggaguguuuacaucuauaggaaaagcucuccaccaagucuuuggagcaaucuauggagcugccuucagugggguuucauggacuaugaaaauccucauaggagucauuauuacauggauaggaaugaacucacgcagcacuucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauaggccaggcuaccacacacaaacagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcaccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggccucaauccaacagccaucuuucuaacaacccucucaagaaccaacaagaaaaggagcuggccacuaaaugaggccaucauggcagucggaauggugagcauucuagccaguucccuccugaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccgauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucgacacgaguggagaugggugaggcagcugggauuuucaugacagccacucccccgggaaguagagauccauuuccucagagcaaugcaccaaucauagaugaagaaagagaaaucccugagcguucauggaauacuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaacccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaaccuagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcggaaggggcauagggaagaugacccugggaaugugcugcauaaucacggcuagcguccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcugaggcauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaacugucgauggaauaacagugauugaucuagauccaauaccuuaugauccaaaguuugaaaagcaguugggacagguaaugcuacuaauccucugcgugacucaaguauugaugaugaggacuacaugggcucugugugaggccuugaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaacuaacacaagaaggggaacuggcaacauaggagagacgcuuggagagaaauggaaaagccgauugaaugcacugggaaaaagugaauuccagaccuacaagaaaaguggaauccaagaaguggauagaaccuuagcaaaagaaggcaucaagagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaauguaagagaagugaaaggccuaacaaaaggaggaccaggacacgaagaacccaucccuaugucaacauauggguggaaucuagugcgucuccagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaaacaagagcacgaaacaucauggcacuacgaucaagaccacccauacaaaacgugggcauaccaugguagcuaugaaacaaaacagacuggaucagcaucauccauggucaacggaguggucaggcuacuaacaaaaccuugggacguccuccccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaagugagaagcaaugcagccuugggggccauauucacugacgagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagaaggaggagccauguacgccgacgacacagcaggaugggacacaagaaucacacuagaagacuuaaaaaaugaagaaaugguaacaaaccacauggaaggagaacacaaaaaauuagccgaggcuauuuucaaacuaacguaucaaaacaagguggugcgugugcaaagaccaacaccaagaggcacaguaauggacaucauaucgagaagagaccaaagaggcagugggcaaguugguaccuauggacucaauacuuucaccaauauggaagcccaauuaaucagacagauggagggagaaggagucuuuaaaaacauccagcaccugacagccacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcugcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6542 - RNA, 9876 nt, Artificial Sequence
  derived and/or modified CDS sequence (wt) from DENV-2__FJ639718__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggccauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucgaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagaguccaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguuccaucggccaaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucucugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugcugacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucuugcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuuccuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggcugacuuggaacuggagaaagcaaccgaugucaaaugggaagaccaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugauauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccaccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaauagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuagucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6543 - RNA, 9876 nt, Artificial Sequence
  derived and/or modified CDS sequence (wt) from DENV-2__GQ868625__SS-prME
ucugcaggcaugaucauuaugcugauuccaacagugauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguuccaucggccgaauguuugagacaacgaugagaggggcgaagagaauggccauuuugggugacacagccugggacuucggaucccugggaggaguguuuacauccauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaagugaaguuaaccaucaugacaggagacaucaaaggaaucaugcaggcaggaaaacgaucucugcggccucagcccacugagcuaaaguauucauggaaaacaugggguaaagcaaaaaugcucuccacagagucuuacaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuuccuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggcugacuuggaacuggagagagcaaccgaugucaaaugggaagaccaggcagagauaucaggaagcaguccaauccugucaauaacaauaucagaagacgguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagcuguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugauauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaauaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacacuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuagucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6544 - RNA, 9876 nt, Artificial Sequence
  derived and/or modified CDS sequence (wt) from DENV-2__KF955401__SS-prME
ucugcaggcaugaucauuaugcugauuccaacaguaauggcguuccaucuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggaguugccuuuagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaaccaucaugacaggagacaucaaaggaaucaugcaggcaggaaagcgaucuuugcggccucagcccacugagcuaaaguauucauggaaaacaugggguaaagcaaaaaugcucuucacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuaggcaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucgggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagagaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggaggggcauagggaagaugacccuaggaaugugcugcauaaucacggcuagcauccuucuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaacaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugauggggaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggaaggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6545 - RNA, 9876 nt, Artificial Sequence
  derived and/or modified CDS sequence (wt) from DENV-2__JF730047__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacauacaaguguccucugcucaggcagaaugagccagaggacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccugagacauccaggcuucaccauaauggcagcaaucuuggcauacaccauagggacgacacauuuccagagagcccugauuuucauucuauugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacaggggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaguaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagagauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugagaggagcaaagagaauggccauuuugggugacacagccugggacuuuggcucccuaggaggaguguuuacaucuauaggaaaagcucuccaccaagucuuuggagcaaucuauggagcugccuucagugggguuucauggacuaugaaaauccucauaggagucauuauuacauggauaggaaugaacucacgcagcacuucacugucugugucacuaguauuggugggaauugugacucuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccacacacaaacagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcaccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggccucaauccaacagccaucuuucuaacaacccucucaagaaccaacaagaaaaggagcuggccacuaaaugaggccaucauggcagucggaauggugagcauucuagccaguucccuccugaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccgauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucgacacgaguggagaugggugaggcagcugggauuuucaugacagccacucccccgggaaguagagauccauuuccucagagcaaugcaccaaucauagaugaagaaagagaaaucccugagcguucauggaauacuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaacccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaaccuagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaacugucgauggaauaacagugauugaucuagauccaauaccuuaugauccaaaguuugaaaagcaguugggacagguaaugcuacuaauccucugcgugacucaaguauugaugaugaggacuacaugggcucugugugaggccuugaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaacuaacacaagaaggggaacuggcaacauaggagagacgcuuggagagaaauggaaaagccgauugaaugcacugggaaaaagugaauuccagaccuacaagaaaaguggaauccaagaaguggauagaaccuuagcaaaagaaggcaucaagagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaauguaagagaagugaaaggccuaacaaaaggaggaccaggacacgaagaacccaucccuaugucaacauauggguggaaucuagugcgucuccagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaaacaagagcacgaaacaucauggcacuacgaucaagaccacccauacaaaacgugggcauaccaugguagcuaugaaacaaaacagacuggaucagcaucauccauggucaacggaguggucaggcuacuaacaaaaccuugggacguccuucccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucauaagaaaagugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagaaggaggagccauguacgccgacgacacagcaggaugggacacaagaaucacacuagaagacuuaaaaaaugaagaaaugguaacaaaccacauggaaggagaacacaaaaaauuagccgaggcuauuuucaaacuaacguaucaaaacaagguggugcgugugcaaagaccaacaccaagaggcacaguaauggacaucauaucgagaagagaccaaagaggcagugggcaaguugguaccuauggacucaauacuuucaccaauauggaagcccaauuaaucagacagauggagggagaaggagucuuuaaaaacauccagcaccugacagccacagaagaaguugccgugaaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccuguuuggggaaaucuuacgcccaaauguggagcuugauguauuuccacaggcgugaccucaggcuggcugcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6546 - RNA, 9876 nt, Artificial Sequence
  derived and/or modified CDS sequence (wt) from DENV-2__JF730048__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacauacaaguguccucugcucaggcagaaugagccagaggacauagacuguuggugcaacuccacguccacguggguaaccuaugggacuuguacuaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccugagacauccaggcuucaccauaauggcagcaaucuuggcauacaccauagggacgacacauuuccagagagcccugauuuucauucuauugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaauacaacaacagaaucccguugcccaacacaaggggaacccagccuaaaagaagagcaggauaagagguucgucugcaaacacuccaugguagacaggggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggaaugcucuccgagaacaggccucgacuucaaugagaugguguugcugcagauggaaaguaaagcuuggcuggugcauaggcaaugguuccuagaccugccacuaccguggcugcccggagcggacaaacaagggucaaauuggauacagaaagaaacauuggucacuuucaaaaauccccaugcaaagaaacaggauguuguuguuuuaggaucucaagaaggggccaugcauacagcacucacaggagccacagagauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugagaggagcaaagagaauggccauuuugggugacacagccugggacuuuggcucccuaggaggaguguuuacaucuauaggaaaagcucuccaccaagucuuuggagcaaucuauggagcugccuucagugggguuucauggacuaugaaaauccucauaggagucauuauuacauggauaggaaugaacucacgcagcacuucacugucugugucacuaguauuggugggaauugugacucuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugcccuaacacaaauagagcuuggaacucguuggagguugaagacuacggcuuuggaguguucaccaccaauauauggcuaaaauugaaagagaaacaggaugcauucugcgacucaaaacucaugucagcagccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccacacacaaacagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcaccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccucaaaauaguaagagacauggaaaaguaucaauuagcagugacuauuauggcuaucuugugcgucccaaacgcagugauauuacagaaugcauggaaagugaguugcacaauacuggcagugguguccguuuccccacugcuuuugacaucuucacagcaaaaaacggauuggauaccauuagcauugacaauuaagggccucaauccaacagccaucuuucuaacaacccucucaagaaccaacaagaaaaggagcuggccacuaaaugaggccaucauggcagucggaauggugagcauucuagccaguucccuccugaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguucccucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguucaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccgauaagauaccaaaccccagcuaucagagcugagcacacugggcgggaaauuguggauuuaaugugucaugccacauuuaccaugaggcugcuaucaccaguuagagugccaaacuacaacuugauuaucauggacgaagcccauuucacagacccagcaaguauagcagcuagaggauacaucucgacacgaguggagaugggugaggcagcugggauuuucaugacagccacucccccgggaaguagagauucauuuccucagagcaaugcaccaaucauagaugaagaaagagaaaucccugagcguucauggaauacuggacaugaguggguuacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugacugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaacccaaaaaaugaaaaugaccaguacauauacaugggagaaccucuggaaaaugaugaagacugugcacacuggaaagaagccaaaaugcuccuagacaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaaccuagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcggaaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagccuggacgcuguaugccguggcuacaacauuuguuacaccaaugcugagacauagcauugagaauuccucagugaauguaucccuaacagcuauagccaaccaagcaacaguguuaaugggucuggggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaacugucgauggaauaacagugauugaucuagauccaauaccuuaugauccaaaguuugaaaagcaguugggacagguaaugcuacuaauccucugcgugacucaaguauugaugaugaggacuacaugggcucugugugaggccuugaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaacuaacacaagaaggggaacuggcaacauaggagagacgcuuggagagaaauggaaaagccgauugaaugcacugggaaaaagugaauuccagaccuacaagaaaaguggaauccaagaaguggauagaaccuuagcaaaagaaggcaucaagagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaauguaagagaagugaaaggccuaacaaaaggaggaccaggacacgaagaacccaucccuaugucaacauauggguggaaucuagugcgucuccagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaaacaagagcacgaaacaucauggcacuacgaucaagaccacccauacaaaacgugggcauaccaugguagcuaugaaacaaaacagacuggaucagcaucauccauggucaacggaguggucaggcuacuaacaaaaccuugggacguccuucccacggugacacagauggcaaugacagacacgacuccauuuggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaagugagaagcaaugcagccuugggggccauauucacugacgagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagaaggaggagccauguacgccgacgacacagcaggaugggacacaagaaucacacuagaagacuuaaaaaaugaagaaaugguaacaaaccacauggaaggagaacacaaaaaauuagccgaggcuauuuucaaacuaacguaucaaaacaagguggugcgugugcaaagaccaacaccaagaggcacaguaauggacaucauaucgagaagagaccaaagaggcagugggcaaguugguaccuauggacucaauacuuucaccaauauggaagcccaauuaaucagacagauggagggagaaggaguuuuuaaaaacauccagcaccugacagccacagaagaaguugccgugaaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccaugcagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcugcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6547 - RNA, 9876 nt, Artificial Sequence
  derived and/or modified CDS sequence (wt) from DENV-2__KF955402__SS-prME
ucugcaggcaugaucauuaugcugauuccaacaguaauggcguuccaccuaaccacacgcaauggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaacugaaacauggaugucaucagaaggggcuuggaaacaugcccagagaauugaaacuuggauccugagacauccaggcuucaccauaauggcggcaauccuggcauacaccauagggacgacacauuuccagagaguccugauuuucauccuacugacagcugucgcuccuucaaugacaaugcguugcauaggaauaucaaauagagucuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaaacuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauuguggugacaccucacucaggggaagagcaugcggucggaaaugacacaggaaaacacggcauggaaaucaaaguaacaccacagagcuccaucacagaagcagaauugacagguuauggcaccgucacgauggagugcuccccgagaacaggccucgacuucaaugagaugguguuacugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacucuaugugcacaggaaaguuuaaaguugugaaggaaauagcagaaacacaacauggaacgauaguuaucagagugcaauaugaaggggacggcucuccaugcaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacauccauaggaaaagcucuccaccaagucuuuggagcaaucuauggaguugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccguucgguaacaagauuggagaaccuaauguggaaacaaauaacaccagaauugaaucacauucuagcagaaaaugaggugaaguuaaccaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggcccugagacagcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaccuaggcaagcuugagauggacuuugauuucugcgauggaaccacagugauagugacugaggacugcggaaauagaggacccucuuugagaacaacuacugccucuggaaaacucauaacagaauggugcugccgaucuuguacauuaccaccccuaagauacagaggugaggaugggugcugguacgggauggaaaucagaccauugaaagagaaagaagaaaaucugguuaacuccuuggucacagccggacaugggcagguugacaauuuuucacuaggagucuugggaauggcauuauuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccucaaaauaguaagaaacauggaaaaguaucaauuagcagugacuaucauggcuaucuugugcgucccaaaugcagugauauuacaaaaugcauggaaagugaguugcacaauacuggcagugguguccguuuccccacuacuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcuuacuggacgaucggccgacuuggaacuggagagagcaaccgaugucaaaugggaagaccaggcagagauaucgggaagcaguccaauccugucaauaacaauaucagaagaugguagcaugucgauaaaaaacgaagaggaagaacaaacacugaccauacucauuagaacaggauugcuggugaucucaggacuuuuuccuauaucaauaccaaucacagcagcagcgugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuuuacagacccagcaaguauagcagcuagaggauacaucucaacccgaguggagaugggugaggcagcugggauuuucaugacagccacuccuccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugaggaaaaauggaaagaaaguaauacaacuuaguagaaagaccuuugauucugaguaugucaagacuagaaccaaugauugggauuucgugguuacaacugacauuucagagaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaacguggaaguugaaaucuggacaaaagaaggggaaaggaagaaauugaaacccagaugguuggaugcuaggaucuacucugacccacuggcgcuaaaagaauucaaagaauuugcagccggaagaaagucucugacucugaaccuaaucacagaaauggguaggcuuccaacauucaugacucagaagacaagagaugcacuggacaaccuagcagugcugcacacggcugaagcagguggaagggcguacaaucaugcucucagugaacuaccggagacccuagagacacugcuuuuacugacacuucuggcuacagucacaggagggaucuuuuuauucuugaugagugggagaggcauagggaagaugacccuaggaaugugcugcauaaucacggcuagcauccuccuaugguacgcacaaauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuucuuagaaaaaacgaagaaagaucuuggauuaggaagcauugcaacccagcaacccgagagcaacauccuggacauagaucuacgucccgcaucagcuuggacgcuguaugccguggcuacaacauucgucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccuauuauugguagcgcauuaugccaucauagggccaggacuucaagcaaaagcaaccagagaagcccagaaaagagcagcggcaggcaucaugaaaaacccaaccgucgauggaauaacagugauugaucuagauccaauaccuuaugauccaaaguuugaaaagcaguuaggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcagugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccaaaucuacaagaaaaguggaauccaggaaguggauagaaccuuagcaaaagaaggcaucaaaagaggagaaacggaccaucaugcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaacgcuucugggaacauagugucaucagugaacaugauuucaaggauguugaucaauagauucacaaugagacacaagaaagcuacuuacgagccggauguugaccucggaagcggaacccguaacauuggaauugaaagugaaacaccaaacuuagacauaauugggaaaagaauagaaaaaauaaaggaagagcaugaaacaucauggcacuacgaccaagaccacccauacaaaacgugggcauaccacgguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugauggggaaaagagaaaagaagcuaggggaauuuggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuauauucuaagagacgugagcaagaaagagggaggagccauguacgccgacgacacagcaggaugggacacaagaaucacauuagaagaccuaaaaaaugaagaaaugguaacaaaccacauggaaggagaacauaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcucaauuaaucagacagauggaaggagaaggagucuuuaaaaacauccagcaccugacagucacagaagaagcugccgugcaaaacugguuggcuagaguggggcgcgaaagguugucaagaauggccaucaguggagaugauuguguugugaaaccuuuagaugacagguucgcaaacgcuuugacagcucugaaugacaugggaaagauuagaaaagacauacaacaaugggaaccuucaaaaggauggaacgauuggacacaagugcccuucuguucacaccauuuccaugagcuaaucaugaaggauggucguguacuuguuguuccauguagaaaucaagaugaacugauuggcagagcccgaaucucccaaggagcaggguggucuuugcgggagacggccuguuuggggaagucuuacgcccaaauguggagcuuaauguauuuccacaggcgugaccucaggcuggcggcaaaugccauuugcucggcagugccaucacacuggguuccaacaagucgaacaaccugguccauacacgcuaaacaugaauggaugacaacggaagacaugcugacagucuggaacaggguguggauucgagaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaggcaggaguucugugguaa

SEQ ID NO: 6548 - RNA, 9876 nt, Artificial Sequence
  derived and/or modified CDS sequence (wt) from DENV-2__FJ898460__SS-prME
acagcaggcgugauuguuauguugauuccaacagcgauagcguuccauuuaaccacacgcaauggagaaccacacaugaucguugguaggcaggagaaagggaaaagucuccuguucaaaacagaggauggugucaacauguguacccucauggccauagaccuuggugaauugugugaagauacaaucacguacaaguguccucuccucagacaaaaugaaccagaagacauagauuguugguguaacucaacguccacauggguaacuuaugggacauguaccaccacaggagaacacagaagggaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgaugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcaucgugaccugugcuauguuuacaugcaaaaagaacauggaaggaaaagucguacagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuucuagaccugccguuaccauggcuacccggagcggacacacaaggaucaaauuggauacagaaagagacauuggucacuuucaaaaauccccacgcuaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaauggggucucauggacuaugaaaauccucauaggagucaucaucacauggauaggaaugaauucacguagcaccucacugucugugucgcuaguauuggugggagucgugacacuguaccugggagccauggugcaggcugauagugguugcguugugagcuggaaaaauaaagaacugaaaugugguagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagagaaugaaguaaaguugaccauuaugacaggagacauuaaaggaaucaugcaggcaggaaaacgauccuuacggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuuccaccaauauauggcuaaaauugagagaaaaacaggauguauuuugugacucaaaacucaugucagcggccauuaaagacaacagagccguccaugccgauaugggcuauuggauagaaagugcacucaaugacacauggaagauggagaaagccuccuucauugaaguuaaaagcugccacuggccaaagucacacacccucuggagcaauggaguauuagaaagugagaugauaauuccaaaaaguuuugccgggccagugucacaacacaacuacagaccaggcuaccauacacaaacagcaggaccuuggcaucuagguaagcuugagauggauuuugauuucugcgaaggaacuacagugguggugacugaggacuguggaaauagaggacccucuuuaagaacgaccacugccucuggaaaacucauaacagaaugguguugccgauccugcacacuaccaccucuaagauacagaggugaggacggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccaugccagagaccauucuugaacugacugaugcguuagccuugggcaugaugguccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcucuuaacauccucacagcagaaagcggauuggauaccauuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggaguuuuuccaguaucgauaccaauuacggcagcagcaugguaccuaugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagagggagaauggaaggaaggagaggaaguccaaguccuggcauuggaaccuggaaaaaaucccagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagacugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacucccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacaucucaacucgaguagagaugggugaagcagccgggauuuucaugacagccacuccuccgggaaguagagacccauuuccccagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucagcaggaagacuuuugacucugaguauguuaagacuagagccaaugauugggacuuuguggucacaacugauauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuagaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugaggggagaagcaaggaaaaccuuuguggaccuaaugagaagaggggacuuaccagucugguuggccuacaaaguggcagcugaaggcaucaacuacgcagacagaaagugguguuuugauggaaucaagaacaaccaaauacuggaagaaaacguggaaguggaaaucuggacaaaagaaggggaaaggaaaaaauuaaaacccagaugguuggaugcuagaaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacagcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagcuacagugcuaaugggucuuggaaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuucuaauccucugcgugacucaaguauuaaugaugaggacaacaugggcuuugugugaggcucuaacccuagcaaccgggcccauuuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuauaagaaaaguggaauccaggaaguggauagaacccuagcaaaagaaggcaucaaaagaggagaaacggaccaccaugcugugucacgaggaucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccguccccaugucaacauauggguggaaucuaguacgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagacaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacucaagaaccgaaggaaggcacaaagaaacugaugaaaauuacagcagaguggcuuuggaaagaacuaggaaagaaaaagacaccuaggauguguaccagagaagaauucacaaaaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggggaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6549 - RNA, 9876 nt, Artificial Sequence
  derived and/or modified CDS sequence (wt) from DENV-2__FJ882602__SS-prME
acugcaggcaugaucaucaugcugauuccaacagcgauggcguuccauuuaaccacacgcaauggagaaccacacaugaucgucagcagacaagagaaagggaaaagucucuuguuuaaaacagaggauggugugaacauguguacccucauggccauggaccuuggugaacugugugaagacacaaucaccuauaacuguccucuucucaggcagaaugaaccagaagauauagauuguuggugcaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauauuuccaaagaguccugauuuucaucuuacugacagcugucgcuccuucaaugacaaugcguuguauaggaauaucaaauagagacuuuguggaagggguuucaggaggaagcuggguugacauagucuuagaacauggaagcugugugacaacgauggcaaaaaacaaaccaacauuggacuuugaacugauaaaaacugaagccaagcaaccugccacucuaaggaaguacuguauagaggcaaagcugaccaacacaacaacagcaucucgcugcccaacacaaggugaacccagccuaaaugaagagcaggacaaaagguucgucugcaaacauuccaugguagacagaggauggggaaauggauguggauuauuuggaaagggaggcaucgugaccugugcuauguucacaugcaaaaaaaacauggaaggaaaaaucgugcagccagaaaaccuggaauacaccauugugauaacaccucacucaggggaagagaaugcaguuggaaaugacacaggaaaacauggcaaggaaaucaaaguaacaccacagaguuccauuacagaagcagaacugacaggcuauggcacugucacgauggagugcucuccgagaacgggccucgacuucaaugagaugguguugcugcaaauggaaaacaaagcuuggcuggugcacaggcaaugguucuuagaccugccguuaccaugguugcccggagcggacacacaaggaucaaauuggauacagaaggagacauuggucaccuucaaaaauccccaugcgaaaaaacaggauguuguuguuuuaggaucccaagaaggggcuaugcauacagcacuuacaggggccacggaaauccagaugucaucaggaaaccuacuguucacaggacaucucaagugcaggcugagaauggacaaacuacagcucaaaggaaugucauacucuaugugcacaggaaaguuuaaagucguaaaggaaauagcagaaacacaacauggaacaauaguuaucagaguacaauacgaaggggaugguucuccauguaaaaucccuuuugagauaauggauuuggaaaaaagacaugucuuaggucgccugauuacagucaacccaauagucacagaaaaagacagcccagucaacauagaagcagaaccuccauucggagacagcuacaucauuauaggaguagaaccaggacaacugaagcucagcugguuuaagaaaggaagcucaaucggccaaauguucgagacaacaaugagaggagcgaagagaauggccauuuuaggugacacagccugggauuucggaucccugggaggaguguucacaucuauaggaaaagcccuucaccaaguuuuuggagcaaucuauggggcugccuucaguggggucucauggacuaugaaaauccucauaggaguuguuaucacauggauaggaaugaauucacguagcaccucacugucuguggcauuaguauuagugggagucgugacauuguauuugggaguuauggugcaggcugauagugguuguguagugaguuggaaaaauaaagaacugaaauguggcagugggauuuuuaucacagacaauguacacacauggacagaacaauacaaauuccaaccagaaucccccucaaagcuggcuucagcuauccagaaagcucaugaagagggcauuuguggaauccgcucaguaacaagacuggagaaucuaauguggaaacaaauaacaccagaacugaaucacauucuaucagaaaaugaggugaaguugacuaucaugacaggagacaucaaaggaaucaugcaggcaggaaaacgaucccugaggccucagcccacugagcugaaguauucauggaaaacauggggcaaagcgaaaaugcucuccacagaaccucauaaccagaccuuucucauugauggccccgaaacagcagaaugucccaacacaaacagagcuuggaacucacuagaaguugaagacuauggcuuugggguguucaccaccaacauauggcugaaguugaaagaaaggcaggauguguuuugugacucaaaacucaugucagcggccauaaaagacaacagagccguccaugccgacauggguuauuggauagaaagcgcacuuaaugacacauggaagauagagaaagccucuuuuaucgaaguuaaaaguugccacuggccaaaaucacauacucucuggaguaauggagugcuagaaagugagaugauaauuccaaagaauuuugcuggaccaguaucacaacauaauuacagaccagguuaucacacacaaacggcaggacccuggcaucuaggcaagcuugagauggacuuugauuuuugcgaaggaaccacagugguggugacugaggacuguggaaauagaggacccucucuaagaacaacuaccgccucuggaaaacucauaacagaaugguguugccgauccugcacauuaccaccgcuaagauacagaggugacgauggauguugguacggaauggaaaucagaccauugaaagagaaggaagagaacuuggucaacucuuuggucacagccggauauggacagauugacaacuucucacuaggagucuugggaauggcauuguuccuggaagaaaugcucaggacccgaguaggaacaaaacaugcaguauuacuaguugcaguuucuuucaugacauugaucacagggaacaugucuuuccgagaccuggggagaguggugguuauggugggggcugcuaugacggaugacauagguaugggcgugacuuaucuugccuugcuagcagccuucaaagucagaccaacuuuugcagcuggacuacuuuugagaaagcugaccucuaaggaauugaugaugaccaccauaggaaucguacuccucucccagaguaccauaccagagacuauacuugaacugacugaugcguuggcuuugggcaugaugauccucaaaauaguaagaaauauggaaaaguaucaauuagcagugacuaucauggcuaucuuaugcguuccaaaugcagugauauuacaaaaugcauggaaagugagcugcacaauacuagcagugguguccguuuccccacugcucuuaacaucuucacagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagccaguucucucuuaaagaaugacauucccaugacaggaccauuaguggcuggagggcuucucacuguguguuacgugcucacuggaagaucggcugauuuggagcuggagagagccgccgacguaagaugggaagaucaggcagagauaucaggaaguaguccaauucugucaauaacaauaucggaagauggcagcaugucgauaaaaaaugaagaggaagaacaaacacugaccauacucauuagaacaggauugcuggugauaucagggcuuuuucccguaucaauaccaaucacggcagcagcaugguaccugugggaagugaagaaacaacgggcuggaguauugugggauguuccuucacccccaccugugggaaaggccgaacuggaagauggagccuauagaaucaagcagaaagggauucuuggauacucccagaucggagcuggaguuuacaaagaaggaacauuccacacaauguggcacgucacacguggugcuguucuaaugcauaaagggaagagaauugaaccaucaugggcggaugucaggaaagaccuaauaucauauggaggaggcuggaagcuagaaggagaauggaaggaaggagaagaaguccaggucuuggcauuagagccuggaaagaauccaagagccguccaaacaaaacccggucuuuuuaaaacuaacaccggaaccauaggcgcuguaucucuagacuuuucuccuggaacgucaggaucuccaaucgucgauaaaaaaggaaaagucgugggucuuuauggcaauggugucgucacaagaaguggaacauaugugagugccauagcccagacugagaaaagcauugaagacaauccagagauugaagaugacaucuuucggaaaagaagauugaccauuauggaccuccacccaggagcgggaaagacgaaaagauaccuuccagcaauagugagagaggccauaaaacgaggcuugagaacauuaauccuggcccccacuagagucguggcagcugaaauggaggaagcccuuagaggacuuccaauaagauaccaaacuccagccaucagagcugagcacacugggcgagaaauuguggauuuaaugugucaugccacauuuaccaugaggcugcuaucaccaguuagagugccaaauuacaaccugaucauuauggaugaagcccauuucacagacccagcaaguauagcagcuagaggauacauuucaacucgaguagagaugggugaagcagcugggauuuucaugacagccacuccuccgggaagcagagacccauuuccucagagcaaugcaccaaucauggaugaggaaagggaaaucccugaacguucguggaauucuggacaugaguggguuacggauuuuaaagggaagacuguuugguuuguuccgaguauaaaagcaggaaaugauauagcagcuugccugagaaaaaauggaaagaaagugauacaacucaguaggaagaccuuugacucugaauacaucaagacuaggaccaaugauugggacuuuguggucacgacugacauuucagaaaugggugcuaacuucaaggcugaaaggguuauagaccccaggcgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagcuaagaugcuucuagacaacaucaacacgccugaaggaaucauucccagcauguucgaaccagagcgugaaaagguggaugccauugacggugaauaccgcuuaagaggagaagcgaggaaaaccuuuguggaccuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggggaaaggaagaaauugaaacccagaugguuggaugcuaggaucuacucugacccguuggcgcucaaagaauucaaagaguuugcagcuggaagaaaaucccugaccuugaauuuaaucacagaaauggguaggcuuccaaccuuuaugacucagaaagcaaggaacgcacuggacaacuuagcaguccugcauacggcugaagcaggcggaagggcguacaaucaugcucucagugaacugccagaaacccuggagacacugcuccugcugacacuuuuagcuacagucacgggcggaaucuuuuuauucuugaugagcggaaaagguauagggaaaaugacccugggaaugugcugcauaaucacggccaguauucuccuaugguacgcacaaauacagccacacuggauagcagcuucaauaauauuggaguuuuuucucauagucuugcucauuccagagccagaaaagcagagaacaccccaagauaaccaauuaacuuacguugucauagccauccucacagugguggcugcaaccauggcaaacgagaugggguuccuggaaaagacgaagaaagaucucggauugggaagcauugcaacccagcaacccgagagcaacauccuggauauagaucuacguccugcaucagcauggacccuguaugccguggccacaacauuuaucacaccaauguugagacauagcauugaaaauuccucagugaaugugucucuaacagccauugccaaccaagccacagugcuaaugggucuugggaaaggauggccauugucaaaaauggacauuggaguuccccuucucgccaucgggugcuauucacaagucaaccccauaacucucacagcagcccuucuuuuauugguagcacauuaugccaucauagggccaggacuccaagcgaaagcaaccagagaagcgcagaaaagagcagcagcaggcaucaugaaaaacccaacuguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaaccuuagcgacugggcccaucuccacauugugggaaggaaauccagggagauuuuggaauacaacuauugcagugucaauggcuaacauuuuuagaggaaguuacuuggcuggagcuggacuucucuuuucuaucaugaagaacacaaccaacacaagaaggggaacuggcaacacaggagagacgcuuggagagaaauggaaaaaccgauugaaugcauuggggaaaagugaauuccagaucuacaagaaaagcggaauccaggaaguggauagaaccuuggcaaaagaaggcauuaaaagaggagaaacggaccaucacgcugugucgcgaggcucagcaaagcugagaugguucgucgagagaaaccugguuacaccagaggggaaaguaguggaccucgguugcggcagagggggcuggucauacuauugugggggccuaaaaaauguaagagaagucaaaggccuaacaaaaggaggaccuggacacgaagaacccauucccaugucaacauauggguggaaucuagugcgucuucaaaguggaguugaugucuucuuuacuccgccagaaaagugugacacauuguugugugacauaggggagucgucaccaaaucccacgguugaagcaggacgaacacucagaguccuaaacuugguggaaaauuggcugaacaacaacacccaauuuugcauaaagguucuuaacccauacaugcccucagucauagaaaaaauggaagcgcugcaaaggaaauacggaggagcuuuggugaggaacccacuuucaagaaauuccacacaugagauguauuggguauccaaugcuuccgggaacauagugucaucagugaacaugauuucaaggauguugaucaauagauuuacaaugagacacaagaaggccacauacgaaccagauguugaccucggaagcggaacccgcaacaucggaauugaaagugagacaccaaaccuagacauaauuggaaaaagaauagaaaaaauaaaacaagagcaugaaacaucauggcauuaugaccaagaccacccauauaaaacgugggccuaccauggcagcuacgaaacaaaacagacuggaucagcaucauccauggugaauggaguaguuagauugcugacaaaaccuugggacgucauuccuauggugacacagauggcaaugacagacacgaccccauuuggacaacagcguguuuucaaagagaaaguggacacgagaacccaagaaccaaaagaaggcacgaagaaacuaaugaaaaucacggcugaauggcucuggaaagaacuaggaaagaaaaagacaccuaggaugugcacuagagaagaauucacaagaaaggugagaagcaaugcagcccuaggugccauauucacugaugagaacaaguggaagucggcacgugaggcuguugaagacagcagauuuugggaacugguugacaaagaaaggaaucuccaucuugaaggaaagugugagacauguguguacaacaugaugggaaagagagagaagaagcuaggggaauucggcaaagcaaaaggcagcagagccauaugguacauguggcuuggagcacgcuucuuagaguuugaagcccuaggauucuugaaugaggaucacugguuuucccgagaaaacucucugaguggaguggaaggagaagggcugcacaagcuggguuacauucuaagagaugugagcaaaaaagaaggaggagcaauguacgccgaugacacugcaggaugggacacaagaaucacacuagaggacuuaaaaaaugaagaaauggugacaaaccacauggaaggagaacacaagaaacuugcugaggccauuuucaaauuaacguaccaaaacaagguggugcgugugcaaagaccgacaccaagaggcacaguaauggauauuauaucgagaagagaccaaagagguaguggacaaguuggcaccuauggccucaacacuuucaccaauaugggagcccaacuaaucagacagauggagggagaagaagucuucaaaggcauccagcaccugacagccacagaagaaauugcagugcaaaacugguuagcaagaguggggcgugagagguuaucaagaauggccaucaguggagaugauuguguugugaaacccuuggaugacagguuugcaagcgcuuuaacagcucuaaaugacaugggaaagguuaggaaagacauacaacaaugggaaccuucaagaggauggaacgauuggacacaagugccuuucuguucacaucauuuccaugaauuaaucaugaaagacggucguguacucguaguuccauguagaaaccaagaugaacugaucgguagagcccgaauuucccagggagccggguggucuuugcgggagacggccugucuagggaaguccuacgcccaaauguggagccugauguacuuccacagacgugaccucaggcuggcggcaaacgcuauuugcucggcaguuccaucacauuggguuccaacaagucgaacaaccugguccauacacgccagacacgaauggaugacaacagaagacaugcugacagucuggaacaggguguggauucaagaaaauccauggauggaagacaaaacuccaguggaaucaugggaggaaaucccauacuuggggaaaagagaagaccaauggugcggcucauugauagggcuaacaagcagggcuaccugggcaaagaacauccaaacagcaauaaaccaagucagauccuuaauaggcaaugaggaauacacagacuauaugccauccaugaaaagauucagaagagaagaggaagaggcaggggucuugugguag

SEQ ID NO: 6550 - RNA, 9876 nt, Artificial Sequence
  derived and/or modified CDS sequence (wt) from DENV-2__GQ252676__SS-prME
acugcaggcgugaucaucaugcugauuccaacagcgauggcguuccauuuaaccacacgcaacggagaaccacacaugaucgucagcaaacaagagaaagggaaaagucucuuguuuaaaacagaggaaggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccucgacuucaaugagaugguguugcugcaaauggaaaauaaggcuuggcuggugcacaggcaaugguucuuagaccugccauuaccaugguugcccggagcggacauacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguuguuagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugauacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguauuugggaguuauggugcaggcugauagugguuguguugugaguuggaaaaacaaagaacugaaauguggcagugggauuuucaucacagacaauguacacacauggacagaacaauacaaauuccaaccagaaucccccucaaagcuggcuucagcuauccagaaagcucaugaagaaggcauuuguggaauccgcucaguaacaagacuggagaaucuaauguggaaacaaauaacaccagaacugaaucacauucuaucagaaaaugagguaaaguugucuaucaugacaggagacaucaaaggaaucaugcaggcaggaaaacgaucccugcggccucagcccacugagcugaaguauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucacaacauaauuacagaccaggcuaucacacacaaacggcaggaccuuggcaucuaggcaagcuugagauggacuuugauuuuugcgaaggaaccacagugguggugacugaggacuguggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacuaguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccauaccagagacuauacuugaacugacugaugcguuggccuugggcaugaugauucucaagauagugagaaauauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucaccguguguuacgugcucacuggaagaucggccgaccuggaacuagagagagccgccgacguuagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggauguuccuucacccccaccugugggaaaggccgaacuggaggauggagcuuacagaaucaagcagaaagggauucuuggauacucccagaucggagcuggaguuuacaaagaaggaacauuccacacaauguggcacgucacacguggugcuguucuaaugcauaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaaaacuaacaccggaaccauaggcgcugugucucuagacuuuucuccuggaacgucaggaucuccaaucgucgacaaaaaaggaaaagucgugggucucuauggcaauggugucgucacaaggaguggaacauaugugagugccauagcccagacugaaaaaagcauugaagacaauccagagauugaagaugauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacuccuccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcagguaaugauauagcagcuugccugagaaaaaauggaaagaaagugauacaacucaguaggaagaccuuugauucugaauacaucaagacuaggaccaaugauugggacuuuguggucacgacugacauuucagaaaugggugcuaacuucaaggcugaaaggguuauagaccccaggcgcugcaugaaaccagucauacuaacagacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaccuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggggaaaggaagaaacugaaacccagaugguuggaugcuaggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagagacccuggagacauugcuuuugcugacacuuuuggccacagucacgggcggaaucuuuuuauucuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaggccacagugcuaaugggucuugggaaaggauggccauugucaaaaauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccucucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaauugaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaggaaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccauuuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuauuugcucggcaguuccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaagaacauccaaacagcaauaaaccaaguuagauccuuaauaggcagugaggaauacacagacuacaugccauccaugaaaagauucagaagagaagaggaagaggcaggggucuugugguag

SEQ ID NO: 6551 - RNA, 9876 nt, Artificial Sequence
  derived and/or modified CDS sequence (wt) from DENV-2__GQ252677__SS-prME
acugcaggcgugaucaucaugcugauuccaacagcgauggcguuccauuuaaccacacgcaacggagaaccacacaugaucgucagcaaacaagagaaagggaaaagucucuuguuuaaaacagaggaaggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacauggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauaguccuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaaguaacaccacagaguuccauuacagaagcagaacugacaggcuacggcacugucacgauggagugcucuccaagaacgggccucgacuucaaugagaugguguugcugcaaauggaaaauaaggcuuggcuggugcacaggcaaugguucuuagaccugccguuaccaugguugcccggagcggacauacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguuguuagaguacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugauacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguauuugggaguuauggugcaggcugauagugguuguguugugaguuggaaaaacaaagaacugaaauguggcagugggauuuucaucacagacaauguacacacauggacagaacaauacaaauuccaaccagaaucccccucaaagcuggcuucagcuauccagaaagcucaugaagaaggcauuuguggaauccgcucaguaacaagacuggagaaucuaauguggaaacaaauaacaccagaacugaaucacauucuaucagaaaaugagguaaaguugucuaucaugacaggagacaucaaaggaaucaugcaggcaggaaaacgaucccugcggccucagcccacugagcugaaguauucauggaaaacguggggcaaagcgaaaaugcucuccacagagccucauaaccagaccuuucucauugauggccccgaaacagcagaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucacaacauaauuacagaccaggcuaucacacacaaacggcaggaccuuggcaucuaggcaagcuugagauggacuuugauuuuugcgaaggaaccacagugguggugacugaggacuguggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacuaguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccauaccagagacuauacuugaacugacugaugcguuggccuugggcaugaugauucucaagauagugagaaauauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauuuuggcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagagauaucaggaagcaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggauguuccuucacccccaccugugggaaaggccgaacuggaagauggagcuuacagaaucaagcagaaagggauucuuggauacucccagaucggagcuggaguuuacaaagaaggaacauuccacacaauguggcacgucacacguggugcuguucuaaugcauaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaaaacuaacaccggaaccauaggcgcugugucucuagacuuuucuccuggaacgucaggaucuccaaucgucgacaaaaaaggaaaagucgugggucucuauggcaauggugucgucacaaggaguggaacauaugugagugccauagcccagacugaaaaaagcauugaagacaauccagagauugaagaugauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacuccuccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcagguaaugauauagcagcuugccugagaaaaaauggaaagaaagugauacaacucaguaggaagaccuuugauucugaauacaucaagacuaggaccaaugauugggacuuuguggucacgacugacauuucagaaaugggugcuaacuucaaggcugaaaggguuauagaccccaggcgcugcaugaaaccagucauacuaacagacggugaagagcgggugauccuggcaggacccaugccagugacccacucuagugcagcacaaagaagagggagaauaggaagaaauccaaaaaaugaaaacgaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaccuaaugagaagaggagaccuaccagucuggcuggccuacagaguggcagccgaaggcauuaacuaugcagacagaaggugguguuuugauggaaucaagaacaaccaaaucuuggaagaaaauguggaaguggaaaucuggacaaaagaaggggaaaggaagaaacugaaacccagaugguuggaugcuaggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagagacccuggagacauugcuuuugcugacacuuuuggccacagucacgggcggaaucuuuuuauucuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucaaaaauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaaccguggauggaauaacagugauugaccuagauccaauacccuaugauccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccucucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaauugaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuaagaaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccauuuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuauuugcucggcaguuccaucacauuggguuccaacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaagaacauccaaacagcaauaaaccaaguuagauccuuaauaggcagugaggaauacacagacuacaugccauccaugaaaagauucagaagagaagaggaagaggcaggggucuugugguag

SEQ ID NO: 6552 - RNA, 9876 nt, Artificial Sequence
  derived and/or modified CDS sequence (wt) from DENV-2__FJ898438__SS-prME
acaguaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguuccaccacaggagaacauagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacauuccaugguagacagaggauggggaaauggauguggauuauuuggaaagggaggcauugugaccugugcuauguuuacaugcaaaaagaacauggaaggaaaagucgugcagccagaaaauuuugaauacaccaucgugauaacaccucacucaggagaagagcaugcuguggguaaugacacaggaaagcauggcaaggaaaucaaaauaacaccacagaguuccaucacagaagcagaacugacaggcuauggcacugucacgauggagugcucuccgagaacgggccucgacuuuaaugagauggugcugcugcagauggaagacaaagcuuggcuggugcacaggcaaugguuccuagaccugccguuaccauggcuacccggagcggacacacaaggaucaaauuggauacaaaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucguuugauuacagucaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacucaaacagagcuuggaacucgcuggaaguugaagacuaugguuuuggaguuuucaccaccaauauauggcugaaauugagagaaaaacaggauguauuuugugacucaaaacucaugucagcggccauuaaggacaacagagccguucaugccgauauggguuauuggauagaaagugcacucaaugacacauggaagauggagaaagccuccuuuauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugauuuuugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacaaaacaugcaauacugcuaguugcagcaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuuuuaacaacucuuucgagaaccagcaagaaaaggagcuggccgcugaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcggccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaauaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuuuuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaacuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguuuggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcuuguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcaggugucuugugguag

SEQ ID NO: 6553 - RNA, 9876 nt, Artificial Sequence
  derived and/or modified CDS sequence (wt) from DENV-2__GQ199893__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguccagagaauugaaaccuggaucuugagacauccaggcuuuaccauaauggcagcaauccuggcauacaccauaggaacgacacauuuccaaaaggccuugauuuucauccuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacacuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucgucguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaacaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcagccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcauuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccuaucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagaucggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaauuccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauagaaguggaaaucuggacaaaagaaggggaaaggaaaaaauuaaaacccagaugguuggaugcuaggaucuauucugacccacuggcacuaaaagaauucaaggaauuugcagcuggaagaaaaucucugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauucucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaagucuacaagaaaaguggaauccaggaaguggauagaacccuagcaaaagaagguaucaaaagaggagaaacggaccaccaugcugugucgcgagguucagcuaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcguuugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaucacccauacaaaacgugggcuuaccacggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacgccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggggaugauuguguuguaaaaccuauagaugauagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6554 - RNA, 9876 nt, Artificial Sequence
  derived and/or modified CDS sequence (wt) from DENV-2__GQ199894__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugcgaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguccagagaauugaaaccuggaucuugagacauccaggcuuuaccauaauggcagcaauccuggcauacaccauaggaacgacacauuuccaaaaggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacacuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucgucguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaacaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucccacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcagccauuaaagacaauagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaacauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcacuguuccuggaagaaaugcucaggacccgaauaggaacgaaacaugcaauacugcuaguugcagcaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcauuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagccaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccuaucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucccagaucggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccugggaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaacccagagaucgaagaugacauuuuccgaaagaaaagauugaccaucauggaccuccauccaggagcaggaaagacaaaaagauaccuuccagccauaguuagagaagccauaaaacgugguuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaauuccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgagggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaaucaagaacaaccaaauacuggaagaaaauauagaaguggaaaucuggacaaaagaaggggaaaggaaaaaauuaaaacccagaugguuggaugcuaggaucuauucugacccacuggcacuaaaagaauucaaggaauuugcagcuggaagaaaaucucugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauucucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuacgauccaaaauuugaaaagcaguuaggacaaguaaugcuccuaauccucugcgugacucaaguauuaaugaugaggacuacaugggcuuugugugaggcucuaaccuuagcgaccgggcccaucuccacacugugggaaggaaauccagggagguuuuggaacacuaccauugcagugucaauggcuaacaucuuuagggggagcuacuuggccggagccggacuucucuuuuccaucaugaaaaacacaacaaacacaagaagaggaacuggcaacauaggagagacacuuggagaaaaauggaaaagucgauuaaacgcacugggaaaaagugaauuucaagucuacaagaaaaguggaauccaggaaguggauagaacccuagcaaaagaagguaucaaaagaggagaaacggaccaccaugcugugucgcgagguucagcuaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcguuugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaucacccauacaaaacgugggcuuaccacggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuuuaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuauauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacgccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggggaugauuguguuguaaaaccuauagaugauagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauaccugggaaaaagagaagaccaauggugcggcucauugauugggcuaacaagcagggcuaccugggcaaagaauauccaaacagcaauaaaucaagucagaucccuuauaggcaaugaggaauacacagacuacaugccauccaugaagagauucagaagggaagaggaagaggcagguguccugugguag

SEQ ID NO: 6555 - RNA, 9876 nt, Artificial Sequence
  derived and/or modified CDS sequence (wt) from DENV-2__FJ898439__SS-prME
acagcaggugugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguuccaccacaggagaacauagaagagaaaaaagaucaguggcgcucguuccacauguggguaugggacuggagacgcgaacugaaacauggaugucaucagaaggggccuggaaacauguucagagaauugaaaccuggaucuugagacacccaggcuuuaccauaauggcagcaauccuggcauacaccauaggaacgacacauuuccaaagggcuuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacuaauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguggguaaugacacaggaaaacauggcaaggaaaucaaaauaacaccacagaguucuaucacagaagcagaacugacaggcuauggcacugucacgauggagugcucuccgagaacgggccucgacuucaaugagauggugcugcugcagauggaagacaaagcuuggcuggugcauaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaggaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacaggaaaagauagcccagucaacauagaagcagaaccuccauucggagacagcuacaucaucauaggaguagagccgggacaauugaaacucaauugguuuaagaagggaagcuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugcccuaacacaaauagagcuuggaacucgcuggaaguugaagacuaugguuuuggaguuuucaccaccaauauauggcugaaauugagagaaaaacaggauguauuuugugauucaaaacucaugucagcggcuauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagguugacaacuuuucacuaggagucuugggaauggcacuguuccuggaagaaaugcucaggacccgaauaggaacgaaacaugcaauacugcuaguugcagcaucuuuuguaacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucuccacugcucuuaacauccucacaacagaaagcggauuggauaccacuggcauugacgauaaaaggucucaauccaacagccauuuuucuaacaacucuuucgagaaccagcaagaagaggagcuggccgcuaaaugaagcugucauggcagucgggauggugagcauuuuagccaguucucuccuaaagaaugacauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguuuugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaagucgugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauucacuaugaggcugcuaucaccagucagagugccaaauuacaaccugaucaucauggaugaagcccacuucacagacccagcaaguauagcagcuagaggauacauuucaacucgaguagagaugggugaagcagccggaauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugacauagcagcuugucuuaggaaaaauggaaagaaagugauacaacuuaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggcuuacaaaguggcagcugaaggcaucaacuacgcagacagaaagugguguuuugauggaaucaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcucccaacuuucaugacucagaaagcaagaaacgcacuggacaacuuggcugugcugcauacggcugagacagguggaaaggcguacaaucaugcucucagugaacugccggagacccuggagacacugcuucuacugacacuccuggcaacagucacaggaggaaucuucuuauucuuaaugagcggaaaaggcauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauucggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuguagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacucuagcaaaggaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaaaaauguaagagaagucaaaggccuaacaaaaggaggaccaggacaugaagaacccauccccaugucaacauauggguggaaucuagugcgucugcaaaguggaguugacgucuuuuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaauaugauuucaaggauguugauuaacagauucacaaugaaacacaagaaagccacuuacgagccugauguugaccuaggaaguggaacccgcaacauugggauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacguugucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagagaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacagguuaggcuacauuuuaagagacgugggaaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaagucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaagucagaaaagacauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaaguagggcuaccugggcaaagaacauccaaacagcgauaaaucaagucagaucccuuauaggcaaugaggaauacacagacuacaugccauccaugaagagauucagaagggaagaggaagaggcaggugucuugugguag

SEQ ID NO: 6556 - RNA, 9876 nt, Artificial Sequence
  derived and/or modified CDS sequence (wt) from DENV-2__GQ868588__SS-prME
acugcaggcaugaucaucaugcugauuccaacagugauggcauuucaucugaccacacgcaacggagaaccacacaugaucgucaguagacaagaaaaagggaaaagccuucuguuuaagacaaaggauggcacgaauauguguacucucauggccuuggaccuuggugaguugugugaagacacaaucacguauaaauguccuuuucucaagcagaacgaaccagaagacauagauuguuggugcaacuccacguccacauggguaacuuacgggacauguaccaccacaggagagcacagaagagaaaaaagaucaguggcgcuuguuccacacgugggaaugggauuggagacacgaacugaaacauggaugucaucagaaggggccuggaaacaugcccagagaauugaaacuuggauucugagacauccaggcuuuaccauaauggccgcaauccuggcauacaccauaggaacgacgcauuuccaaagaguccugauauucauccuacugacagccaucgccccuucaauggcaaugcgcugcauaggaauaucaaauagggacuuuguggaaggagugucaggagggaguuggguugacauaguuuuagagcauggaaguugugugacgacgauggcaaaaaauaaaccaacacuggacuuugaacugauaaaaacagaagccaaacaacccgccaccuuaaggaaguacuguauagaggcuaaacugaccaacacgacaacagacucgcgcugcccaacacaaggggaacccacccugaaugaagagcaggacaaaagguuugucugcaaacauuccaugguagacagaggauggggaaauggauguggauuguuuggaaaaggaggcaucgugaccugugcuauguucacaugcaaaaagaacauggaaggaaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguuacgauggagugcucuccaagaacgggccucgacuucaaugagaugguguugcugcaaauggaagacaaagcuuggcuggugcacagacaaugguuccuagaccuaccguugccauggcugcccggagcagacacacaaggaucaaauuggauacagaaagagacauuggucaccuucaagaauccccaugcgaaaaaacaggauguuguugucuuaggaucccaagaaggggccaugcauacagcacucacaggggcuacggaaauccagaugucaucaggaaaccugcuguucacaggacaucuuaaaugcaggcugagaauggacaaauuacaacuuaaagggaugucauacuccaugugcacaggaaaguuuaaaauugugaaggaaauagcagaaacacaacauggaacaauagucauuagaguacaauaugaaggagacggcucuccaugcaagauccccuuugagauaauggaucuggaaaaaagacauguuuugggccgccugaucacagucaacccaauugugacagaaaaggacaguccagucaacauagaagcagaaccuccauucggagacagcuacaucaucauaggaguggaaccaggacaauugaagcuggacugguucaggaaaggaaguuccaucggccaaauguuugagacaacaaugaggggagcgaaaagaauggccaucuugggcgacacagccugggauuuuggaucucugggaggaguguucacaucaauaggaaaagcucuccaccagguuuuuggagcaaucuacggggcugcuuucaguggggucucauggacuaugaagauccuuauaggaguuaucaucacauggauaggaaugaacucacgcagcacaucacugucugugucacugguauuagugggaaucgugacacuguacuugggaguuaugguucaagccgauagugguugcguugugagcuggaagaacaaagaacuaaaauguggcaguggaauauucgucacagauaacgugcauacauggacagaacaauacaaguuccagccagaauccccuucaaaacuggcuucagccauccagaaagcucacgaagaaggcaucuguggaauccgcucaguaacaagacuggaaaaucuuauguggaaacagauaacaucagaauugaaucauauucuaucagaaaaugaagugaaacugaccaucaugacaggagacaucaaaggaaucaugcagguaggaaaacgaucucugcggccucaacccacugaguugagguauucauggaaaacaugggguaaagcgaaaaugcucuccacagaacuccacaaucagacuuuccucauugauggucccgaaacagcggaaugccccaacacaaacagagcuuggaauucacuagaaguugaggacuauggcuuuggaguauucacuacuaauauauggcuaagacugagagaaaagcaggauguauuuugugacucaaaacucaugucagcggccauaaaggacaacagagccguccaugcugauauggguuacuggauagaaagcgcacucaaugauacauggaagauagagaaagcuucuuucauugaagucaaaaguugccacuggccaaagucacacacucuauggaguaauggagugcuagaaagcgagaugguaauuccaaagaauuucgcuggaccagugucacaacauaauaacagaccaggcuaucacacacaaacagcaggaccuuggcaucuaggcaagcuugagauggacuuugauuucugcgaagggaccacaguggugguaaccgaggaauguggaaacagagggccuucuuuaagaacaaccacugccucaggaaaacucauaacggaaugguguugccgaucuugcacacuaccaccacuaagauacagaggugaggauggaugcugguacgggauggaaaucagaccauugaaagagaaagaagaaaaucuggucaguucucuggucacagccggacaugggcagaucgacaauuucucauuaggaauucugggaauggcacuguuccuugaagaaaugcucaggacucgaguaggaacgaaacaugcaauacuacuagucgcaguuucuuucguaacguuaaucacagggaacaugucuuuuagagaccugggaagagugaugguuauggugggugccaccaugacagaugacauaggcaugggugugacuuaucuugcucuacuagcagccuucaaagucagaccaaccuuugcagcuggacugcucuugagaaaacugaccuccaaggaauuaaugaugaccaccauaggaaucguucuucucucucagaguagcauaccagagaccauucuugagcugaccgaugcguuagcuuuaggcaugaugguccucaagauggugagaaacauggaaaaauaucagcuggcagugacuaucauggcuauuuugugugucccaaaugcugugauauuacagaacgcauggaaagugaguugcacaauacuggcaguggugucugucuccccccugcucuugacauccucacaacagaaagcggacuggauaccauuagcguugacgaucaaaggccucaauccaacagccauuuuucuaacaacccucucaagaacuagcaagaaaaggagcuggccuuuaaacgaggccaucauggcgguugggauggugaguaucuuggccagcucucucuugaagaacgacauccccaugacaggaccauuaguggcuggagggcuucuuacugugugcuacguauuaacugggcggucagccgaucuggaacuggagagagcuaccgaugucaaaugggaugaccaggcagagauaucagguagcaguccaauucugucaauaacaauaucagaagauggcagcaugucgauaaagaaugaagaggaagagcaaacacugacuauacucauuagaacaggauugcuugugaucucaggacucuuuccgguaucaauaccaauuacagcagcagcaugguaccugugggaaguaaagaaacaacgggcuggaguguugugggauauccccucaccaccacccgugggaaaggcugaauuggaagauggagccuacagaaucaagcaaaaaggaauccugggauauucccagaucggagcuggaguuuacaaagaaggaacauuucacaccauguggcacgucacacguggcgcuguccuaaugcauaaggggaagaggaucgaaccgucaugggcggacgucaagaaagacuuaauaucauauggaggagguuggaagcuagaaggagaauggaaagaaggagaagaaguccaggucuuggcauuggagccugggaaaaauccaagagccguccaaacaaaaccuggccuuuuuagaaccaauacuggaaccauaggugccguaucccuggacuuuucccccgggacgucaggaucuccaaucguugacaaaaaaggaaaaguuguaggccucuauggcaauggugucguuacaaggaguggagcauaugugagugccauagcucagacugaaaaaagcauugaagacaauccagaaauugaagaugacaucuuucgaaagagaagauugacuaucauggaucuccacccaggagcaggaaagacaaagaaauaccucccggccauagucagagaggccauaaaaagaggcuugagaacacuaauccuagcccccacuagagucguggcagcugaaauggaggaagcccuuagaggacuuccaauaagauaccaaacuccagccaucagggcugagcacaccgggcgggagaucguggacuuaaugugucaugccacauuuaccaugaggcugcuaucaccaaucagagugccaaauuacaaccugaucaucauggacgaagcccauuuuacagauccagcaagcauagcagcuaggggauacaucucaacucgaguggagaugggugaggcagcuggaauuuuuaugacagccacuccuccggguagcagagauccauuuccucagaguaaugcaccaauuauggacgaagaaagagaaauuccggaacguucauggaacuccgggcacgagugggucacggauuuuaaaggaaagacugucugguuuguuccaagcauaaaaaccggaaaugacauagcagccugccugagaaagaauggaaagagggugauacaacucaguaggaagaccuuugauucugaauacgucaagacuagaaccaaugacugggauuucgugguuacaacugacauuucggaaaugggugcuaacuuuaaagcugagaggguuauagaccccagacgcugcaugaaaccaguuauacugacagacggcgaagagcgggugauucuggcaggacccaugccagugacccacuccagugcagcacaaagaagagggagaauaggaaggaauccaaggaaugaaaaugaucaauacauauauaugggagaaccccuggaaaaugaugaagacugugcgcacuggaaggaagcuaagaugcuccuagauaacaucaacacaccugaaggaaucauucccagcauguucgagccagagcgugaaaagguggaugccauugacggugaauaucgcuugagaggagaagcacggaaaacuuuuguggaccuaaugagaagaggagaccuaccagucugguuggcuuauaaaguggcaucugaagguaucaacuacgcagacagaagaugguguuuugacggaaccagaaacaaucaaaucuuggaagaaaauguggaaguggaaauuuggacaaaggaaggggaaaggaaaaaauugaaaccuagaugguuagaugcuaggaucuacuccgacccacuggcgcuaaaagaauucaaggaauucgcagccggaagaaagucccuaacccugaaccuaaucacagagaugggcagacucccaacuuuuaugacucagaaggccagagaugcacuagacaacuuggcggugcugcacacggcugaagcggguggaaaggcauacaaucaugcucucagugaacuaccggagacccuggagacauugcuuuugcugacacuguuggccacagucacgggaggaaucuuucuauuccugaugagcggaagggguauagggaagaugacccugggaaugugcugcauaaucacggccagcauccucuuaugguaugcgcaaauacaaccacauuggauagcagcuucaauaauauuggaguucuuucucauagucuugcucauuccagaaccagaaaagcagaggacaccccaggauaaccaauugacuuaugucaucauagccauccucacagugguggccgcaaccauggcaaacgaaauggguuuucuagaaaaaacaaagaaagaccucggacugggacacauugcaacucagcaaccugagagcaacauucuggauauagaucuacguccugcaucagcauggacguuguaugccguggcuacaacauuuaucacaccaauguugagacauagcauugaaaauuccucaguaaaugugucccuaacagccauagcuaaccaagccacagugcuaaugggucucgggaaaggauggccauugucaaagauggacauuggagucccccuccuugccauuggguguuacucacaagucaacccuauaacccucacagcggcucuucuuuuauugguagcacauuaugccaucauuggaccgggacuucaagccaaagcaaccagagaagcccagaaaagagcagcagcgggcaucaugaaaaacccaacuguggauggaauaacagugauagaucuagauccaauacccuaugauccaaaguuugaaaagcaguugggacaaguaaugcuccuaguccuuugugugacccaagugcugaugaugaggacuacgugggcuuugugugaagccuuaacucuagcaaccggacccgugucuacauugugggaaggaaauccagggagauucuggaacacaaccauugcagugucaauggcaaacaucuuuagagggaguuaccuugcuggagcuggacuucucuuuucuaucaugaagaacacaacuagcacgagaagaggaacuggcaacauaggagaaacgcuaggagagaaauggaaaagcagacugaacgcauuggggaaaagugaauuccagaucuacaaaaaaaguggaauucaagaaguggacagaaccuuagcaaaagaaggcaucaaaagaggagaaacggaucaucacgcugugucgcgaggcucagcaaaacugagaugguucguugaaagaaauuuggucacaccagaagggaaaguaguggaccuugguugcggcagagggggcuggucauacuauuguggaggauugaagaauguaagagaaguuaaaggcuuaacaaaaggaggaccaggacacgaagaaccuaucccuaugucaacauauggguggaaucuaguacgcuuacagagcggaguugacguuuuuuuuguuccaccagagaagugugacacauuguugugugacauaggggaaucaucaccaaaucccacgguagaagcgggacgaacacucagaguccuuaaccuaguggaaaauuggcugaacaauaacacucaauuuugcguaaagguucuuaacccguacaugcccucagucauugaaagaauggaaaccuuacaacggaaauacggaggagccuuggugagaaauccacucucacggaauuccacacaugaaauguacuggguguccaaugcuuccgggaacauagugucaucagugaacaugauuucaagaaugcugauuaacagauucaccaugagacacaagaaggccaccuaugagccagaugucgaccucggaagcggaacccgcaacauuggaauugaaagugagacaccgaaccuagacauaauugggaaaagaauagaaaaaauaaaacaagagcaugaagcgucauggcacuaugaccaagaccacccauacaaaacaugggcuuaccauggcagcuaugaaacaaaacagacuggaucagcaucauccauggugaacggaguagucagauugcugacaaaacccugggacguuguuccaauggugacacagauggcaaugacagacacaacucccuucggacaacagcgcgucuucaaagagaagguggauacgagaacccaagaaccaaaagaaggcacaaaaaaacuaaugaaaaucacggcagaguggcucuggaaagaacuaggaaagaaaaagacacccagaaugugcaccagagaagaauucacaaaaaaggugagaagcaaugcagccuugggggccauauuuaccgaugagaacaaguggaagucggcgcgugaggcuguugaagauaauagguuuugggagcugguugacaaggaaagaaaccuccaucuugaaggaaaaugugaaacauguauauacaacaugaugggaaaaagagagaaaaaacuaggagaguuugguaaagcaaaaggcagcagagcuauaugguacauguggcuuggagcacgcuucuuagaguuugaagcccuaggauuuuugaaugaagaccauugguucucuagagagaacucccugaguggaguggaaggagaagggcugcauaaacuagguuacaucuuaagagaggugagcaagaaagaaggaggagcaauguaugccgaugacaccgcaggcugggacacaagaaucacaauagaggauuuaaaaaaugaagaaaugauaacgaaccacauggcaggagaacacaagaaacuugccgaggccauuuuuaaauugacguaccaaaacaagguggugcgugugcaaagaccaacaccaagaggcacgguaauggacaucauaucgagaagagaccaaagggguaguggacaaguuggcaccuauggccucaacacuuucaccaacauggaagcacaacuaauuaggcaaauggagggggaaggaaucuucaaaagcauccagcacuugacagccucagaagaaaucgcugugcaagauuggcuaguaagaguagggcgugaaagguugucaagaauggccaucaguggagaugauuguguugugaaaccuuuagaugauagauuugcaagagcucuaacagcucuaaaugacaugggaaagguuaggaaggacauacagcaaugggagcccucaagaggauggaacgacuggacacaggugcccuucuguucacaccauuuucacgaauuaaucaugaaagauggucgcauacucguagucccaugcagaaaccaagaugaauugaucggcagagcccgaauuucccagggagcuggguggucuuuacgggagacggccuguuuggggaagucuuacgcccaaauguggagcuugauguacuuccacagacgugaucucaggcuagcggcaaaugccaucugcucggcagucccgucacacuggguuccaacuagccggacaaccugguccauacacgccagccaugaauggaugacgacggaagacauguugacaguuuggaauagaguguggauccuagaaaauccauggauggaagacaaaacuccaguggaaucaugggaagaaaucccauaccugggaaaaagagaagaccaauggugcggcucgcugauugggcugacaagcagagccaccugggcgaagaauauccagacagcaauaaaccaagucagaucccucauuggcaaugaggaauacacagauuacaugccauccaugaaaagauucagaagagaagaggaagaggcaggaguuuugugguag

SEQ ID NO: 6557 - RNA, 9876 nt, Artificial Sequence
  derived and/or modified CDS sequence (wt) from DENV-2__GQ868590__SS-prME
acugcaggcaugaucaucaugcugauuccaacagugauggcguuucaucugaccacacgcaacggagaaccacacaugaucgucaguagacaagaaaaagggaaaagccuucuguuuaagacaaaggauggcacgaacauguguacucucauggccauggaccuuggugaguugugugaagacacaaucacguauaaauguccuuuucucaagcagaacgaaccagaagacauagauuguuggugcaacuccacguccacauggguaacuuacggaacauguaccaccacaggagagcacagaagagaaaaaagaucaguggcgcuuguuccacacgugggaaugggauuggaaacacgaacugaaacauggaugucaucagaaggggccuggaaacaugcccagagaauugaaacuuggauucugagacauccaggcuuuaccauaauggccgcaauccuggcauacaccauaggaacgacgcauuuccaaagaguccugauauucauccuacugacagccaucgcuccuucaaugacaaugcgcugcauaggaauaucaaauagggacuuuguggaaggagugucaggagggaguuggguugacauaguuuuagaacauggaaguugugugacgacgauggcaaaaaauaaaccaacacuggacuuugaacugauaaaaacagaagccaaacaacccgccaccuuaaggaaguacuguauagaggcuaaacugaccaacacgacaacagacucgcgcugcccaacacaaggggaacccacccugaaugaagagcaggacaaaagguuugucugcaaacauucuaugguagacagaggauggggaaauggauguggauuguuuggaaaaggaggcaucgugaccugugcuauguucacaugcaaaaagaacauggaagggaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguuacgauggagugcucuccaagaacgggccucgacuucaaugagaugguguugcugcaaauggaagacaaagcuuggcuggugcacagacaaugguuccuagaccuaccguugccauggcugcccggagcagacacacaaggaucaaauuggauacagaaagagacauuggucaccuucaaaaauccccaugcgaaaaaacaggauguuguugucuuaggaucccaagaaggggccaugcacacagcacucacaggggccacggaaauccaaaugucaucaggaaaccugcuguucacaggacaucucaaaugcaggcugagaauggacaaauuacaacuuaaagggaugucauacuccaugugcacaggaaaguuuaaaauugugaaggaaauagcagaaacacaacauggaacaauagucauuagaguacaauaugagggagacggcucuccaugcaagauccccuuugagauaauggaucuggaaaaaagacauguuuugggccgccugaucacagucaacccaauuguaacagaaaaggacaguccagucaacauagaagcagaaccuccauucggagacagcuacaucaucauaggaguggaaccaggacaauugaagcuagacugguucaagaaaggaaguuccaucggccaaauguuugagacaacaaugaggggagcgaaaagaauggccaucuugggcgacacagccugggauuuuggaucucugggaggaauguucacaucaauaggaaaagcucuccaccagguuuuuggagcaaucuacggggcugcuuucaguggggucucauggacaaugaagauccuuauaggaguaauuaucacauggauaggaaugaacucacguagcacaucacugucugugucacugguauuagugggaaucgugacacuguacuugggaguuauggugcaagccgauagugguugcguugugagcuggaagaacaaagaauuaaaauguggcaguggaauauucgucacagauaacgugcacacauggacagaacaauacaaguuucaaccagaauccccuucaaaacuggcuucagccauccagaaagcucacgaagaaggcaucuguggaauccgcucaguaacaagacuggaaaaucuuauguggaaacagauaacaccagaauugaaucauauucuaucagaaaaugaagugaaacugaccaucaugacaggagacaccaaaggaaucaugcagguaggaaaacgaucucugcggccucaacccacugaguugagauauucauggaaaacaugggguaaagcgaaaaugcuccccacagaacuccauaaucagaccuuccucauugaugguccugaaacagcagaaugccccaacacaaacagagcuuggaauucacuagaaguugaggacuauggcuuuggaguauucacuaccaacauauggcuaagauugagagaaaagcaggauguauuuugugacucaaaacucaugucagcggccauaaaggauaacagagccguccaugcugauauggguuauuggauagaaagcgcacucaaugauacauggaagauagagaaagcuucuuucauugaagucaaaaguugccacuggccaaagucacacacucuauggaguaauggagugcuagaaagcgagaugguaauuccaaagaaucucgcuggaccagugucacaacauaauaacagaccaggcuaucacacacaaacagcaggaccuuggcaucuaggcaagcuugagauggacuuuaauuucugcgaagggaccacaguggugguaaccgaggaauguggaaacagagggccuucuuuaagaacaaccacugccucaggaaaacucauaacggaaugguguugucgaucuugcacacuaccaccacuaagauacagaggugaggauggaugcugguacgggauggaaaucagaccauugaaagagaaagaagaaaaucuggucaguucucuggucacagccggacaugggcagauugacaauuucucauuaggaauuuugggaauggcacuguuccuugaagaaaugcucaggacucgaguaggaacgaaacaugcaauacuacuagucgcaguuucuuucguaacguuaaucacagggaacaugucuuuuagagaccugggaagagugaugguuauggugggugccacuaugacagaugacauaggcauggguguaacuuaucuugcucuacuagcagccuacaaagucagaccaaccuuugcagcuggauuacucuugagaaaacugaccuccaaggaauuaaugaugaccaccauaggaaucguucuucucucucagaguagcauaccagagaccauucuugagcugaccgaugcguuagcuuuaggcaugaugguccucaagauggugagaaacauggaaaaauaucagcuggcagugacuaucauggcuauuuugugugucccaaaugcugugauauuacagaacgcauggaaagugaguugcacaauacuggcaguggugucuguuuccccccugcucuugacauccucacaacagaaagcggacuggauaccauuagcguugacgaucaaaggccucaauccaacagccauuuuucuaacaacccucucaagaacuagcaagaaaaggagcuggccuuuaaacgaggccaucauggcgguugggauggugaguaucuuggccagcucucucuugaagaacgacauccccaugacaggaccauuaguggcuggagggcuucuuacugugugcuacguguugacugggcggucagccgaucuggaacuagagaaagcuaccgaugucaaaugggaugaccaggcagagauaucagguagcaguccaauucugucaauaacaauaucagaagauggcagcaugucgauaaagaaugaagaggaagagcaaacacugacuauacucauuagaacaggauugcuugugaucucaggacucuuuccgguaucaauaccaauuacagcagcagcaugguaccugugggaaguaaagaaacagcgggcuggaguguugugggauguccccucaccaccacccgugggaaaggcugaauuggaagauggagccuacagaaucaagcaaaaaggaauccuaggauauucccagaucggagcuggaguuuacaaagagggaacauuucacaccauguggcacgucacacguggcgcuguccuaaugcauaaggggaagaggauugaaccgucaugggcggacgucaagaaagacuuaauaucauauggaggagguuggaagcuagaaggagaauggaaagaaggagaagaaguccagguuuuggcauuggagccugggaaaaauccaagagccguccaaacaaaaccuggccuuuuuagaaccaauacuggaaccauaggugccguaucccuagacuuuuccccugggacgucaggaucuccaaucguugacaaaaaaggaaaaguuguaggccucuauggcaauggugucgucacaaggaguggagcauaugugagugccauagcucagacugaaaaaagcauugaagacaauccagagauugaagaugacaucuuucgaaagagaagauugacuaucauggaucuccacccaggagcaggaaagacaaagaaauaccucccggccauagucagagaggccauaaaaagaggcuugagaacacuaauccuugcccccacuagagucguggcagcugagauggaggaagcccuuagaggacuuccaauaagauaccaaacuccagcuaucagggcugaacacaccgggcgggagaucguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaauuuuuaugacagccacuccuccggguagcagagauccauuuccucagaguaaugcaccaauuauggaugaagaaagagaaauuccggaacguucauggaacuccgggcacgagugggucacggauuuuaaaggaaagacugucugguuuguuccaagcauaaaaaccggaaaugacauagcagccugccugagaaagaauggaaagagggugauacagcucaguaggaagaccuuugauucugaauacgucaagacuagaaccaaugacugggauuucgugguuacaacugacauuucggaaaugggugccaacuuuaaagcugagaggguuauagaccccagacgcugcaugaaaccaguuauacugacagacggcgaagagcgggugauccuggcaggacccaugccagugacccacuccagugcagcacaaagaagagggagaauaggaaggaauccaaggaaugaaaaugaucaauacauauauaugggagaaccccuggaaaaugaugaagacugugcgcacuggaaggaagcuaagaugcuccuagauaacaucaacacaccugaaggaauuauucccagcauguucgggccagagcgugaaaagguggaugccauugacggugaauaucgcuugagaggagaagcacggaaaacuuuuguggaacuaaugagaagaggagaccuaccagucugguuggcuuauaaaguggcaucugaagguaucaacuacgcagacagaagaugguguuuugacggaaccagaaacaaucaaaucuuggaagaaaauguggaaguggaaaucuggacaaaggaaggggaaaggaaaaaauugaaaccuagauggcuagaugcuaggaucuacuccgacccacuggcgcuaaaagaauucaaggaauucgcagccggaagaaagucucuaacccugaaccuaaucacagagaugggcagacucccaacuuuuaugacucagaaggccagagacgcacuagacaacuuggcggugcugcacacggcugaagcggguggaaaggcauacaaucaugcucucagugaacuaccggagacccuggaaacauugcuuuugcugacacugcuggccacagucacgggaggaaucuuucuauuccugaugagcggaagggguauagggaagaugacccugggaauguguugcauaaucacggccagcauccucuuaugguaugcacaaauacaaccacauuggauagcagcuucaauaauauuggaguucuuucucauagucuugcucauuccagaaccagaaaagcagaggacaccccaggauaaucaauugacuuaugucaucauagccauccucacagugguggccgcaaccauggcuaacgaaauggguuuucuagaaaaaacaaagaaagaccucggacugggacacauugcaacucagcaaccugagagcaacauucuggacauagaucuacguccugcaucagcauggacguuguaugccguggcuacaacauuuaucacaccaauguugagacauagcauugaaaauucuucaguaaaugugucucuaacagccauagcuaaccaagccacagugcuaaugggucucgggaaaggauggccauugucaaagauggacauuggaguuccccuccuugcuauuggguguuacucacaaguuaacccuauaacccucacagcggcucuucuuuuauugguagcacauuaugccaucauaggaccgggacuucaagccaaagcaaccagagaggcucagaaaagagcagcggcgggcaucaugaaaaacccaacuguggauggaauaacagugauagaucuagauccaauacccuaugauccaaaguuugaaaagcaguugggacaaguaaugcuccuaguccuuugugugacccaagugcugaugaugaggacuacgugggcuuugugugaagccuuaacucuggcaacuggacccguguccacauugugggaaggaaauccagggagauucuggaacacaaccauugcagucucaauggcaaacaucuuuagagggaguuaccuugcuggagcuggacuucucuuuucuaucaugaaaaacacaacuagcacgagaagaggaacuggcaacauaggagaaacgcuaggagagaaauggaaaagcagacugaacgcauuggggaaaagugaauuccagaucuacaaaaaaaguggaauucaagaaguggacagaaccuuagcaaaagaaggcauuaaaagaggagaaacggaucaucacgcugugucgcgaggaucagcaaaacugagaugguucgucgaaagaaauuuggucacaccagaagggaaaguaguggaccuuggcugcggcagagggggcuggucauacuauuguggaggauugaagaauguaagagaaguuaaaggcuuaacaaaaggaggaccaggacacgaagaaccuaucccuaugucaacauauggguggaaucuaguacgcuuacagagcggaguugacguuuuuuuuauuccaccagagaagugugacacacuguugugugacauaggggaaucaucaccaaaucccacgguagaagcgggacgaacacucaggguccuuaaccuaguggaaaguuggcugaacaauaacacccaauuuugcguaaagguucuuaacccguacaugcccucagucauugaaagaauggaaaccuuacaacggaaauacggaggagccuuggugagaaauccacucucacggaauuccacacaugaaauguacuggguguccaaugcuuccgggaacguaguaucaucagugaacaugauuucaagaaugcugauuaacagauucaccaugagacacaagaaggccaccuaugagccagaugucgaccucggaagcggaacccgcaacauuggaauugaaagugagacaccgaaccuagacauaauugggaaaagaauagaaaaaauaaaacaagagcaugaagcgucauggcacuaugaccaagaccacccauacaaaacaugggcuuaccauggcagcuaugaaacaaaacagacuggaucagcaucauccauggugaacggaguagucagauugcugacaaaacccugggacguuguuccaauggugacacagauggcaaugacagacacaacuccuuucggacaacagcgcgucuuuaaagagaagguggauacgagaacccaagaaccaaaagaaggcacaaaaaaacuaaugaaaaucacggcagaguggcucuggaaagaacuaggaaagaaaaagacaccuagaaugugcaccagagaagaauucacgaaaaaggugagaagcaaugcagccuugggggccauauuuaccgaugagaacaaguggaaaucggcacgugaagcuguugaagauaauagguuuugggagcugguugacaaggaaagaaaccuccaucuugaaggaaaaugugaaacauguguauacaacaugaugggaaaaagagagaaaaaacuaggagaguuugguaaagcaaaaggcagcagagccauaugguacauguggcucggagcacgcuucuuagaguuugaagcccuaggauuuuugaaugaagaccauugguucuccagagagaacucccugaguggaguggaaggagaaggacugcauaaacuagguuacaucuuaagagaggugagcaagaaagaaggaggagcaauguaugccgaugacaccgcaggcugggacacaagaaucacaauagaggauuuaaaaaaugaagaaaugauaacgaaccacauggcaggagaacauaagaaacuugccgaggccauuuuuaaauugacguaccaaaacaagguggugcgugugcaaagaccaacaccaauagguacaguaauggacaucauaucgagaagagaccaaagggguagugggcaaguuggcaccuauggccucaacacuuucaccaacauggaagcacaacuaaucaggcaaauggagggggaaggaaucuucaaaagcauccagcacuugacagccucagaagaaaucgcugugcaagauuggcuaguaagaguagggcgugaaagguugucaagaauggccaucaguggagaugauuguguugugaaaccuuuagaugauagauuugcaagagcucuaacagcucuaaaugacaugggaaagguuaggaaggacauacagcaaugggagcccucaagaggauggaacgacuggacacaggugcccuucuguucacaccauuuucacgaguuaauuaugaaagauggucgcacacucguaguuccaugcagaaaccaagaugaauugaucggcagagcccgaauuucccagggagcuggguggucuuuacgggagacggccuguuuggggaagucuuacgcccaaauguggagcuugauguacuuucacagacgugaucucaggcuagcggcaaacgccaucugcucggcagucccgucacacuggguuccaacaagccggacaaccugguccauacacgccagccaugaauggaugacgacggaagacauguugacaguuuggaacagaguguggauccuagaaaauccauggauggaagacaaaacuccaguggaaucaugggaggaaaucccauaucugggaaaaagagaagaccaauggugcggcucgcugauugggcugacaagcagagccaccugggcgaagaauauccagacagcaauaaaccaagucagaucccucauuggcaaugaggaauacacagauuacaugccauccaugaaaagauucagaagagaagaggaagaggcaggaguuuugugguag

SEQ ID NO: 6558 - RNA, 9876 nt, Artificial Sequence
  derived and/or modified CDS sequence (wt) from DENV-2__GQ868497__SS-prME
acagcaagcgugauuguuauguugauuccaacagugauggcguuccaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguuccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaauggauguggauuauuuggaaagggaggcauugugaccugugcuauguucacaugcaaaaagaacauggaaggaaaagucaugcagccagaaaauuuggaauacaccaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacaugucuuaggucgcuugauuacagucaacccaaucguaacagaaaaagauagcccagucaauauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacauccauaggaaaggcucuccaccaaguuuuuggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguguuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuggguaagcuugagauggacuucgauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcagcaucuuuugugacauugauuacugggaacaugucuuuuagagacuugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuucuccacugcucuuaacauccucacagcagaaagcggauuggauaccacuggcauugacgauaaaaggucuuaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccgauccugucaauaacaauaucagaagauggcagcaugucgguaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauucacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacagcucaguagaaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcacaaagaagagggagaauaggaagaaauccaaaaaaugaaaacgaccaguacauauacaugggggaaccucuugaaaaugaugaagacugugcacauuggaaagaagcuaaaaugcuccuagacaacaucaacacacccgaaggaaucauuccuaguauguucgaaccagagcgugaaaaaguggaugccauugauggugaauaccguuugagaggggaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcuuauuccagaaccagaaaaacagagaacaccccaagacaaccaauugaccuauguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucggcugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauugcugugugacauaggggagucgucaccaaaucccacgauagaggcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacgagagcaugaaacaucauggcacuaugaucaagaccacccauacaaaacgugggcuuaccaugguagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuauauuuuaagagacgugggcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaaaggaagaggaagaggcaggugucuugugguag

SEQ ID NO: 6559 - RNA, 9876 nt, Artificial Sequence
  derived and/or modified CDS sequence (wt) from DENV-2__GU131959__SS-prME
acagcaggcgugauuguuauguugauuccaacagugauggcguuccaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguuccaccacaggagaacacagaagagaaaaaagaucaguggcgcucguuccacacguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaauggauguggauuauuuggaaagggaggcauugugaccugugcuauguucacaugcaaaaagaacauggaaggaaaagucgugcagccagaaaauuuggaauacaccaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaaaaaacaggaugucguuguuuuagggucucaagaaggagccaugcacacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacagucaacccaaucguaacagaaaaagauagcccagucaauauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaauacacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugaaacauggaagauggagaaagccuccuucauugaaguuaaaagcugcuacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuggguaagcuugagauggacuucgaucucugcgaagggacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcagcaucuuuugugacauuaauuacugggaacaugucuuuuagagacuugggaagagugaugguuauggugggcgcaaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuuccccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaagucuuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauucacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggagagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguagaaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcacaaagaagagggagaauaggaagaaauccaaaaaaugaaaacgaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcugugcugcacacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuagcauccuccuaugguaugcacagauacaaccacacuggauagcagcuucaauaauacuggaguuuuuucucauaguuuugcuuauuccagaaccagaaaaacagagaacaccccaagacaaccaauugaccuauguugucauagccauccucacagugguggccgcaaccauggcaaacgagauggguuuccuggaaaaaaccaagaaagaccuaggauugggaagcauuacaacccaggaaucugagaguaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucggcugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauuguugugugacauaggggagucgucaccaaaucccacgauagaggcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauauaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaaggaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuauauuuuaagagacgugggcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauuuaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguagggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaaaggaagaggaagaggcaggugucuugugguag

SEQ ID NO: 6560 - RNA, 9876 nt, Artificial Sequence
  derived and/or modified CDS sequence (wt) from DENV-2__GQ868515__SS-prME
acagcaggcgugauuguuauguugauuccaacagugauggcguuccaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggauaacuuaugggacauguuccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaacggauguggauuauuuggaaagggaggcauugugaccugugcuauguucacaugcaaaaagaacauggaaggaaaagucgugcagccagaaaauuuggaauacacuaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacgauaugaaggggacgguucuccauguaagaucccuuuugagauaacagauucggaaaaaagacacgucuuaggucgcuugauuacagucaacccaaucguaacagaaaaagauaguccagucaauauagaagcagaaccuccauucggagacagcuacaucaucauaggaguagagccgggacaauugaaacucaauugguuuaagaaaggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaacucacguagcaccucacugucugugucgcuaguauuggugggugucgugauacuguaccugggagcuauggugcaagcugauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucccacaaucagacuuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaccuggguaagcuugagauggacuucgaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcagcaucuuuugugacauugauuacugggaacaugucuuuuagagauuugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagagcauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgaacauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaaaaaagugauacaacucaguagaaagacuuuugacucugaguauguuaagacuagagccaaugauugggacuuuguagucacaacugacauuucagaaaugggugccaacuucaaggcugagaggguuauagaccccagacguugcaugaaaccagucauacuaacagauggcgaagagcgggugaucuuggcaggacccaugccagugacccacucuagugcagcacaaagaagagggagaauaggaagaaauccaaaaaaugaaaacgaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugaugggauuaagaauaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcuguacugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacagcuaguauccuccuaugguacgcacagauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggagucccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguuaggacaaguaaugcucuuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugcgaugguucgucgagagaaauauggucacaccggaagggaaggugguggaucucgguugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauuguugugugacauaggggagucgucaccaaaucccacgauagaggcaggacgaacacucagaguccucaacuuaguggaaaauugguugaacaauaacacccaauuuugcauaaagguccucaacccauacaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaauauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccaaaggaagguacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaaacauucagcaccugacagccacagaagaaaucgcuguacagaacugguuagcaagaguggggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaaccccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaaaggaagaggaagaggcaggugucuugugguag

SEQ ID NO: 6561 - RNA, 9876 nt, Artificial Sequence
  derived and/or modified CDS sequence (wt) from DENV-2__GQ868516__SS-prME
acagcaggcgugauuguuauguugauuccaacagugauggcguuccaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggauaacuuaugggacauguuccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaacggauguggauuauuuggaaagggaggcauugugaccugugcuauguucacaugcaaaaagaacauggaaggaaaagucgugcagccagaaaauuuggaauacacuaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacagucaacccaaucguaacagaaaaagauaguccagucaauauagaagcagaaccuccauucggagacagcuacaucaucauaggaguagagccgggacaauugaaacucaauugguuuaagaaaggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaacucacguagcaccucacugucugugucgcuaguauuggugggugucgugauacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucccacaaucagacuuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaccuggguaagcuugagauggacuucgaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcagcaucuuuugugacauugauuacugggaacaugucuuuuagagauuugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagagcauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgaacauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaaaaaagugauacaacucaguagaaagacuuuugacucugaguauguuaagacuagagccaaugauugggacuuuguagucacaacugacauuucagaaaugggugccaacuucaaggcugagaggguuauagaccccagacguugcaugaaaccagucauacuaacagauggcgaagagcgggugaucuuggcaggacccaugccagugacccacucuagugcagcacaaagaagagggagaauaggaagaaauccaaaaaaugaaaacgaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuugccagucugguuggccuacaaaguggcagcugaaggcaucaacuacgcagauagaaagugguguuuugaugggauuaagaauaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcuguacugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacagcuaguauccuccuaugguacgcacagauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggagucccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguuaggacaaguaaugcucuuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugcgaugguucgucgagagaaauauggucacaccggaagggaaggugguggaucucgguugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauuguugugugacauaggggagucgucaccaaaucccacgauagaggcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaauauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccaaaggaagguacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaaacauucagcaccugacagccacagaagaaaucgcuguacagaacugguuagcaagaguggggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaaccccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaaaggaagaggaagaggcaggugucuugugguag

SEQ ID NO: 6562 - RNA, 9876 nt, Artificial Sequence
  derived and/or modified CDS sequence (wt) from DENV-2__GU131975__SS-prME
acagcaggcgugauuguuauguugauuccaacagugauggcguuucaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggauaacuuaugggacauguuccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaacggauguggauuauuuggaaagggaggcauugugaccugugcuauguucacaugcaaaaagaacauggaaggaaaagucgugcagccagaaaauuuggaauacacuaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucccaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacagucaacccaaucguaacagaaaaagauaguccagucaauauagaagcagaaccuccauucggagacagcuacaucaucauaggaguagagccgggacaauugaaacucaauugguuuaagaaaggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaacucacguagcaccucacugucugugucgcuaguauuggugggugucgugauacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucccacaaucagacuuuucuuauugauggcccugaaacagcagaaugccccaacacaaacagagcuuggaacucgcuggaaguugaagacuaugguuuuggaguuuucaccaccaauauaugguugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguacuagaaagugagaugauaaucccaaaaaauuuugccgggccagugucacaacacaacuacagaccaggcuaccauacacaaacagcaggaccuuggcaccuggguaagcuugagauggacuucgaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcagcaucuuuugugacauugauuacugggaacaugucuuuuagagauuugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagagcauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcugaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagaggaaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaaaaaagugauacaacucaguagaaagacuuuugacucugaguauguuaagacuagagccaaugauugggacuuuguagucacaacugacauuucagaaaugggugcuaacuucaaggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaacgaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcuguacugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacagcuaguauccuccuaugguacgcacagauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggagucccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguugggacaaguaaugcucuuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugcgaugguucgucgagagaaauauggucacaccggaagggaaggugguggaucucgguugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauuguugugugacauaggggagucgucaccaaaucccacgauagaggcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaauauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccaaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaagucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaaacauucagcaccugacagccacagaagaaaucgcuguacagaacugguuagcaagaguggggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaaaggaagaggaagaggcaggugucuugugguag

SEQ ID NO: 6563 - RNA, 9876 nt, Artificial Sequence
  derived and/or modified CDS sequence (wt) from DENV-2__JN819422__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacuccacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguccagagaauugaaaccuggaucuugagacauccaggcuuuaccauaauggcagcaauccuggcauacaccauaggaacgacacauuuccaaaaggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaauaaaccaacacuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuuuaaugagauggugcugcugcagauggaagacaaagcuuggcuggugcacaggcaaugguuccuagaccugccguuaccauggcuaccuggagcggacacacaaggaucaaauuggauacagaaagagacauuggucacuuucaaaaauccccacgcgaagaaacaggaugucgucguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaacaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcagccauuaaagacaauagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcacuguuccuggaagaaaugcucaggacccgaauaggaacgaaacaugcaauacugcuagucgcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugaccgaugcauuagccuugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaaaaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccuaucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacguccccucacccccaccaguggaaaaagccgaacuggaggauggagccuacagaaucaagcaaagagggauucuuggauauucucagaucggagccggaguuuacaaagaaggaacauuccauacaauguggcacgucacacguggugcuguucugaugcauagagggaagaggauugaaccaucaugggcagaugucaagaaagaccuaauaucauauggaggagguuggaagcuagaaggagaauggaaggaaggggaggaaguccaaguccuggcacuggaaccugggaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugccauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccaccagaguaguggcagcugaaauggaggaagcucuuagaggacuuccaauaagauaccaaaccccagccaucaaaacccagcauaccgggcgggagaucguggaccuaaugugucaugccacauuuacuaugaggcugcuaucaccagucagaguaccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaauuccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuuuaaggcugagaggguuauagaccccagacguugcaugaaaccaguuauacuaacagauggcgaagagcgggugaucuuggcaggaccaaugccagugacccacucuagugcagcgcaaagaagagggagaauaggaagaaauccaaagaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaacuuuuguggaccuaaugagaagaggggacuuaccagucugguuggccuacaaaguggcagcugaaggcaucaacuacgcagacagaaagugguguuuugauggaaucaagaacaaccaaauacuggaagaaaauauagaaguggaaaucuggacaaaagaaggggagaggaaaaaauuaaaacccagaugguuggaugcuaggaucuauucugacccacuggcacuaaaagaauucaaggaauuugcagcuggaagaaaaucucugacccugaaccugaucacagaaauggguaggcuuccaacuuucaugacucagaaagcaagaaacgcacuggacaacuuggcugugcugcauacggcugaggcagguggaagggcguacaaucaugcucucagugaacugccggagacccuggaaacacugcuucuacugacacuccuggcaacagucacaggaggaaucuucuuauucuuaaugagcggaaaagguguagggaagaugacccugggaauguguugcauaaucacggcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauucucacagugguggccgcaaccauggcaaacgagauggguuuccuagaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcagguaucaugaaaaacccaacaguagauggaauaacagugauugaccuagaaccaauacccuaugauccaaaauuugaaaagcaguuaggacaaguaaugcuccuaauucucugcgugacucaaguauuaaugaugaggacuacaugggcucugugugaggcucuaaccuuagcgaccgggccuaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaagucuacaagaaaaguggaauccaggaaguggauagaacccuagcaaaagaagguaucaaaagaggagaaacggaccaccaugcugugucgcgagguucagcuaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcguuugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaucacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaggaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaagggaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuauauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacgccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggggaugauuguguuguaaaaccuauagaugauagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6564 - RNA, 9876 nt, Artificial Sequence
  derived and/or modified CDS sequence (wt) from DENV-2__GU131955__SS-prME
acagcaggcgugauuguuauguugauuccaacagugauggcguuccaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguuccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaacagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaauggauguggauuauuuggaaagggaggcauugugaccugugcuauguucacaugcaaaaagaacauggaaggaaaagucgugcagccagaaaauuuggaauacaccaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacagucaacccaaucguaacagaaaaagauagcccagucaauauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaguauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacuuaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaucauacacaaacagcaggaccuuggcaucuggguaagcuugagauggacuucgaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucauuaggagucuugggaauggcacuguuccuggaagaaaugcucaggacccgaauaggaacgaaacaugcaauacugcuaguugcagcaucuuuugugacauugauuacugggaacaugucuuuuagagacuugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcaauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguagaaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcacaaagaagagggaggauaggaagaaauccaaaaaaugaaaacgaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauuguugugugacauaggggagucgucaccaaaucccacgauagaggcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaaggccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacagaguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaaaagauucagaaaggaagaggaagaggcaggugucuugugguag

SEQ ID NO: 6565 - RNA, 9876 nt, Artificial Sequence
  derived and/or modified CDS sequence (wt) from DENV-2__KJ189311__SS-prME
acagcaggcgugauuguuauguugauuccaacagugauggcguuucaucuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggauaacuuaugggacauguuccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacacccaggcuuuaccauaauggcagcaauccuggcauacaccauaggaacgacacauuuucaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggacuuugaacugauaaaaacagaagccaaacaaccugccacucuaaggaaguacuguauagaagcaaagcugaccaacacaacaacagaaucgcguugcccaacacaaggggaacccagucuaaaugaagagcaggauaaaagguucaucugcaaacacuccaugguagacagaggauggggaaacggauguggauuauuuggaaagggaggcauugugaccugugcuauguucacaugcaaaaagaacauggaaggaaaagucgugcagccagaaaauuuggaauacacuaucgugauaacaccucacucaggagaagagcacgcuguggguaaugacacaggaaagcauggcaaggaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucccaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacagucaacccaaucguaacagaaaaagauaguccagucaauauagaagcagaaccuccauucggagacagcuacaucaucauaggaguagagccgggacaauugaaacucaauugguuuaagaaaggaaguuccaucggccaaauguuugagacaacaaugagaggagcaaagagaauggccauuuuaggugacacagccugggacuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaacucacguagcaccucacugucugugucgcuaguauuggugggugucgugauacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucccacaaucagacuuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguacuagaaagugagaugauaaucccaaaaaauuuugccgggccagugucacaacacaacuacagaccaggcuaccauacacaaacagcaggaccuuggcaccuggguaagcuugagauggacuucgaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcagcaucuuuugugacauugauuacugggaacaugucuuuuagagauuugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaagaauugaugauggccaccauaggaaucgcacuccuuucccaaagcaccauaccagagagcauucuugaacugacugaugcguuagccuugggcaugaugguccucaaaauagugagaaauauggaaaaauaccaauuggcagugaccaucauggcuauuucgugugucccaaacgcagugauacugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcugaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccacacaauguggcacgucacacguggugcuguucugaugcauagaggaaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaaucuagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaaaaaagugauacaacucaguagaaagacuuuugacucugaguauguuaagacuagagccaaugauugggacuuuguagucacaacugacauuucagaaaugggugcuaacuucaaggcugagaggguuauagaccccagacguugcaugaaaccagucauacuaacagauggcgaagagcgggugaucuuggcaggaccuaugccagugacccacucuagugcagcacaaagaagagggagaauaggaagaaauccaaaaaaugaaaacgaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccuaaaccuaaucacagaaauggguaggcuuccaacuuucaugacucagaaagcaagaaacgcacuggacaacuuggcuguacugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacagcuaguauccuccuaugguacgcacagauacaaccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggccacaacauuugucacaccaauguugagacauagcauugaaaauuccucagugaaugucucccuaacggccauugcuaaccaagcuacagugcuaaugggucuugggaaaggauggccauugucaaagauggacauuggagucccccuccuugccauuggaugcuauucacaagucaacccuauaacucucacagcagcucuucuuuuauugguagcacauuaugccauuauagggccaggacuucaagcaaaagcaacuagagaagcucagaaaagagcagcagcagguaucaugaaaaacccaacagucgauggaauaacagugauugaccuagaaccaauacccuaugauccaaaauuugaaaagcaguuaggacaaguaaugcucuuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugcgaugguucgucgagagaaauauggucacaccggaagggaaggugguggaucucgguugcgguagagggggcuggucauacuauugugggggacuaaaggauguaagagaagucaaaggccuaacaaaaggaggaccaggacaugaagaacccauccccaugucaacauauggguggaaucuagugcgucugcaaaguggaaucgacguuuucuucaccccgccagaaaagugugauacauuguugugugacauaggggagucgucaccaaaucccacgauagaggcaggacgaacacucagaguccucaacuuaguggaaaauugguugaacaauaacacccaauuuugcauaaagguccucaacccauauaugccuucagucauagaaaaaauggaaacauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaauauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccaaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaagucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaaacauucagcaccugacagccacagaagaaaucgcuguacagaacugguuagcaagaguggggcgugaaaggcugucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaaaggaagaggaagaggcaggugucuugugguag

SEQ ID NO: 6566 - RNA, 9876 nt, Artificial Sequence
  derived and/or modified CDS sequence (wt) from DENV-2__KJ189370__SS-prME
acagcaggcgugauuguuauguugauuccaacggcgauggcguuccauuugaccacacgcaauggagaaccacacaugaucguuaguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccagguuuuaccauaauggcagcaaucuuggcauacacuauaggaacgacacauuuccaaagggccuugauuuucaucuugcugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccagccacucuaaggaaguacuguauagaagcaaagcugaccaacacaacaacagaaucacguuguccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaauauggaaggaaaagucgugcagccagaaaacuuggaauacaccaucgugauaacaccccacucaggagaagagcacgcuguagguaaugacacaggaaagcauggcaaagaaaucaagauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaacuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagagugcaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuacauuaucauaggaguagagccgggacaauugaaacucaauugguuuaagaagggaaguuccaucggccaaauguuugagacaacaaugagaggagcaaagagaauggccauucuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaauuugauguggaaacaaauaacaccagaauugaaccauauucuaucagaaaaugagguaaaguugaccauuaugacaggagacauuaaaggaaucaugcaggcaggaaaacgaucuuugcggccccagcccacugagcugaaguauucauggaaaacaugggggaaggcgaaaaugcucuccacagagucucacaaucagaccuuucuuauugauggcccugaaacagcagaaugccccaacacaaacagagcuuggaacucacuggaaguugaagacuaugguuuuggaguuuucaccaccaauauauggcugaaauugaaagaaaaacaggauguauuuugugacucaaaacucaugucagcggccauuaaagacaacagagccguucaugccgauauggguuauuggauagaaagcgcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagaaaaagaggagaauuuggucaacuccuuggucacagccggacaugggcagauugacaacuuuucauuaggaguccugggaauggcacuguuccuggaagaaaugcucaggacccgaauaggaacgaaacaugcaauacugcuaguugcaguaucuuuugugacauugauaacugggaacauguccuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaacugaugauggccaccauaggaaucgcgcuccuuucccaaagcaccauaccagagaccauucuugaacugacugaugcauuagccuugggcaugaugguccucaaaguggugagaaauauggaaaaauaccaauuggcagugacuaucauggcuauuucgugugucccaaaugcagugauacugcaaaacgcauggaaggugaguugcacaauauuggcggcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuucuaaagaaugacauuccuaugacagguccauuaguggcuggagggcuccuuaccguauguuaugugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgagcuggaggauggagccuacagaaucaagcaaagagggauucuuggauauucucagauaggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccugggaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagacgacauuuuccggaagaaaagauugaccaucauggaccuccauccaggagcaggaaagacaaaaagauaccuuccagccauaguuagagaagccauaaaacguggcuugagaacauugaucuuggcucccacuagaguaguggcagcugaaauggaggaagcucuuagaggacuuccaauaagauaccaaaccccagccaucaaagccgaguauaccgggcgggagaucguggaccuaaugugucaugccacauuuacuaugagguugcuaucaccagucagagugccaaauuacaaccugaucaucauggacgaagcccacuucacagacccagcuaguauagcagcuagaggauacaucucaacucgaguagagaugggugaagcagcugggauuuucaugacagccacuccuccgggaaguagagacccauuuccucagagcaacgcaccgaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacaucucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaauaucaauacacccgaaggaaucauuccuaguauguucgaaccagagcgugaaaaaguggaugccauugauggugaauaccgcuugagaggggaagcaaggaaaaccuuuguggaccuaaugagaagaggggacuuaccagucugguuggccuacaaaguggcagcugaaggcauuaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcacacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacagcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaauauccuggacauagaucuacgcccugcaucagcauggacgcuguaugccguggcuacaacauuucucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccagggcuucaagcaaaagcaaccagagaagcucagaaaagagcagcagcaggcaucaugaaaaacccaacagucgauggaauaacagugauugaccuagacccaauacccuaugauccaaaauuugaaaagcagcuaggacaagugaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugccgugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacucagaguccucaacuuaguggaaaauugguuaaacaauaacacucaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaucuaggaaguggaacccguaacaucggaauugaaagugagguaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacagcagaguggcuuuggaaagaacuaggaaagaaaaagacacccaggauguguaccagagaagaauucacaagaaaagugagaagcaacgcagccuugggggccauauucacugaugagaacaaauggaaaucggcacgugaggcuguugaagauggcagguuuugggagcugguugacagggaaagaaaucuccaucuugaaggaaagugugaaacauguguguauaacaugaugggaaaaagagagaagaaacugggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagaagugggcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaaucgcuguacagaacugguuaguaagaguggggcgugaaaggcuaucaagaauggcaaucaguggagaugauuguguuguaaaaccuauagaugacagauuugcaagugcuuuaacagcucuaaaugacaugggaaaaguuagaaaagacauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuacuugggcaaagaauauccaaacagcaauaaaucaaguuagaucccuuauaggcaaugaggaauacacagacuacaugccauccaugaagagauucagaagggaagaggaagaggcagguguccugugguag

SEQ ID NO: 6567 - RNA, 9876 nt, Artificial Sequence
  derived and/or modified CDS sequence (wt) from DENV-2__EU482620__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagacuuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaagucuuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuucuaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccaccggaaaagugugacacauugcugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacacccaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgagugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6568 - RNA, 9876 nt, Artificial Sequence
  derived and/or modified CDS sequence (wt) from DENV-2__FJ373300__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaccaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaguauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6569 - RNA, 9876 nt, Artificial Sequence
  derived and/or modified CDS sequence (wt) from DENV-2__EU596495__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacaggaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugacuuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6570 - RNA, 9876 nt, Artificial Sequence
  derived and/or modified CDS sequence (wt) from DENV-2__EU596497__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaauaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucauacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6571 - RNA, 9876 nt, Artificial Sequence
  derived and/or modified CDS sequence (wt) from DENV-2__EU569695__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucccuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccgucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6572 - RNA, 9876 nt, Artificial Sequence
  derived and/or modified CDS sequence (wt) from DENV-2__EU482623__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaagaaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacugcuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacagcggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccauugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugagggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6573 - RNA, 9876 nt, Artificial Sequence
  derived and/or modified CDS sequence (wt) from DENV-2__EU569698__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaauacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacucauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacauuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6574 - RNA, 9876 nt, Artificial Sequence
  derived and/or modified CDS sequence (wt) from DENV-2__EU569699__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaaaggaggcauugugaccugugcuaaguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuaucgauggcccugaaacagcagaaugccccaacacaaacagagccuggaacucgcuggaaguugaagacuaugguuuuggaguuuucaccaccaauauauggcugaaauugagagauaaacaggauguauuuugugacucaaaacucaugucagcggccauuaaagacaacagagccguucaugcugauauggguuauuggauagaaagugcacucaaugacacauggaagauggaaaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguaugggauggaaaucagaccauugaaagagaaagaagagaauuuggucaacuccuuggucacagccggacaugggcagauugacaacuuuucacuaggagucuugggaauggcacugcuccuggaagaaaugcucaggacccgaauaggaacgaaacaugcaauacuacuaguugcagugucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcugggcuacucuuaagaaaacugaccuccaaggaauugaugauggccaccauaggaaucgcacuccuuucccaaagcaccauaccagaaaccauucuugaacugacugaugcauuagcccugggcaugaugguccucaaaauagugagaaauauggaaaaauaccaauuggcagugacugucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugcgcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaauauggacaaaagaaggggaaaggaaaaaguuaaaacccagaugguuggaugcuaggaucuauucugacccacuagcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauagucuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccggacccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaggaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaagcaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucauugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcacuuauggccuuaauaccuucaccaauauggaagcccaauuaauuagacagauggagggagaaggaaucuucaaaagcauucagcaccugacagccauagaagaaaucgcuguacagaacuggcuagcaagaguggggcgugaaaggcuaucaagaauggcaaucaguggagaugauuguguuauaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuuggggaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauuuagaagggaagaggaagaggcagguguccugugguag

SEQ ID NO: 6575 - RNA, 9876 nt, Artificial Sequence
  derived and/or modified CDS sequence (wt) from DENV-2__KF955366__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaauacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacguuccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugcuacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuucuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6576 - RNA, 9876 nt, Artificial Sequence
  derived and/or modified CDS sequence (wt) from DENV-2__EU569700__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaauacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6577 - RNA, 9876 nt, Artificial Sequence
  derived and/or modified CDS sequence (wt) from DENV-2__KF955369__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacaacugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagauagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcauuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggagaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6578 - RNA, 9876 nt, Artificial Sequence
  derived and/or modified CDS sequence (wt) from DENV-2__EU569702__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacugcauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaauccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagacuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaauacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagagagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcggcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcacaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauagcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaccuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugcgacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6579 - RNA, 9876 nt, Artificial Sequence
  derived and/or modified CDS sequence (wt) from DENV-2__EU482624__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcaaacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacauacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuaugugcacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcacgaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6580 - RNA, 9876 nt, Artificial Sequence
  derived and/or modified CDS sequence (wt) from DENV-2__EU596500__SS-prME
acagcaggugugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugccauguuuacaugcaaaaagaacauggaaggaaaagucgugcagccagaaaacuuggaguacaccaucgugauaacaccacacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcuaagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagccauccaaaaagcucaugaagagggcauuuguggaauccgcucaguaacaagauuggagaaucugauguggaaacaaauaacaccagaauugaaucauauucuaucagaaaaugagguaaaauugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugguaaucccaaaaaauuuugccgggccagugucacaacacaacuacagaccaggcuaccauacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacgauaucagaagauggcagcaugucgauaaaaaaugaagaggaagaacaaacacugaccauacuuaucagaacgggauuguuggugaucucaggagucuuuccaguaucgauaccaaucacggcagcagcaugguaccugugggaaguaaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaucaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggaaacccuggagacacugcuucuacugacacuccuggcaacagucacaggaggaaucuucuuauucuuaaugaguggaaaaaguauagggaagaugacccugggaauguguugcauaaucacggcuagcauccuccuauggcaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggauauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccucuuugccauuggaugcuauuaccaagucaacccuauaacucuaacagcagcucuucuucuauugguagcacauaaugccauuauaggccaaggacuacaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaagugaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucgacauauggguggaaucuagugcgucugcaaaguggaguugacguuuucuucaccccgccggaaaagugugacacauugcugugugacauaggggagucgucaccaaaccccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaaaugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauagguaaugaggaauacacagauuacaugccauccaugaagagauucagaagggaagaggaagaggcagguguccugugguag

SEQ ID NO: 6581 - RNA, 9876 nt, Artificial Sequence
  derived and/or modified CDS sequence (wt) from DENV-2__EU482626__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacauacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacucagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6582 - RNA, 9876 nt, Artificial Sequence
  derived and/or modified CDS sequence (wt) from DENV-2__EU482629__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacuccauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuugguuaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuaaagaccugggaagagugaugguuaugaugggcgcuaccaugacggaugacauagguaugggagugacuuaucuugcccuacuagcugcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaagauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauacguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaagcauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaauuacagaaauggguaggcuuccaacuuucaugacccagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaaggcauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuuaucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacucuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaauuuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauccagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaauuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6583 - RNA, 9876 nt, Artificial Sequence
  derived and/or modified CDS sequence (wt) from DENV-2__FJ390390__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaaaggaggcauugugaccugugcuaaguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuaucgauggcccugaaacagcagaaugccccaacacaaacagagccuggaacucgcuggaaguugaagacuaugguuuuggaguuuucaccaccaauauauggcugaaauugagagauaaacaggauguauuuugugacucaaaacucaugucagcggccauuaaagacaacagagccguucaugcugauauggguuauuggauagaaagugcacucaaugacacauggaagauggagaaagccuccuucauugaagucaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguaugggauggaaaucagaccauugaaagagaaagaagagaauuuggucaacuccuuggucacagccggacaugggcagauugacaacuuuucacuaggagucuugggaauggcacugcuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcugggcuacucuuaagaaaacugaccuccaaggaauugaugauggccaccauaggaaucgcacuccuuucccaaagcaccauaccagaaaccauucuugaacugacugaugcauuagcccugggcaugaugguccucaaaauagugagaaauauggaaaaauaccaauuggcagugacugucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacgauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaagaccgagcauaccgggcgggagaucguggaccuaaugugucaugccacauuuacuaugaggcuguuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugcgcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaauauggacaaaagaaggggaaaggaaaaaguuaaaacccagaugguuggaugcuaggaucuauucugacccacuagcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccggacccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaggaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaagcaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucauugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauuuagaagggaagaggaagaggcagguguccugugguag

SEQ ID NO: 6584 - RNA, 9876 nt, Artificial Sequence
  derived and/or modified CDS sequence (wt) from DENV-2__FJ390391__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauuuuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagagccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaaaugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6585 - RNA, 9876 nt, Artificial Sequence
  derived and/or modified CDS sequence (wt) from DENV-2__FJ882593__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcaugguaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaagaaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugagguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauccccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggaguuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6586 - RNA, 9876 nt, Artificial Sequence
  derived and/or modified CDS sequence (wt) from DENV-2__FJ182014__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccuuuccucagacaaaaugaaccagaagacauagauuguuggugcaacucuacguccacauggguaacuuaugggacauguacuaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaauaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguucaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagauuuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6587 - RNA, 9876 nt, Artificial Sequence
  derived and/or modified CDS sequence (wt) from DENV-2__FJ547090__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaaguugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcgaccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagacuaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacgcggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6588 - RNA, 9876 nt, Artificial Sequence
  derived and/or modified CDS sequence (wt) from DENV-2__EU482630__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccuuuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuuuugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaaaaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguucaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagauuuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6589 - RNA, 9876 nt, Artificial Sequence
  derived and/or modified CDS sequence (wt) from DENV-2__FJ882594__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacaauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaagggucaaauuggauacagaaagagacauuggucacuuucaaaaauccccacgcgaagaaacaggaugucguugucuuagggucucaagaaggggccaugcacacggcacucacaggggccacagaaauucagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucgcuaguauuggugggcguugugacacuguaccugggagcuauggugcaagcugauagugguuguguugugagcuggaaaaauaaagaacugaaauguggcagcgggaucuucaucacagauaauguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaagcaggauguauuuugugacucaaaacucaugucagcggccauuaaagacaacagagccguccaugcugauauggguuauuggauagaaagugcacucaaugauacauggaagauggagaaagccuccuucauagaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcggcuuuuaaaguuagaccaacuuuugcagcuggacuacucuuaagaaaacugaccuccaaggaauugaugauggccaccauaggaaucgcacuccuuucccaaagcaccauaccagagaacauucuugaacugacugaugcauuagcccugggcaugaugguccucaagauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucuuaauccaacagccauuuuuuuaacaacucucucgagaaccagcaagaaaaggagcuggccgcuaaaugaagcuaucauggcaguugggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaacuuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuugaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauucgucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcguaacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucuuuuuuccaucaugaaaaauacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaagcaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccaaaggaaggcacaaagaaacugaugaaaauuacggcagaguggcuuuggaaagaacuaggaaagaaaaagacaccuaggauguguaccagagaagaauucacaaaaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcagggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacagugauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6590 - RNA, 9876 nt, Artificial Sequence
  derived and/or modified CDS sequence (wt) from DENV-2__FJ205885__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugccauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugaggggagcaaagagaauggccauuuuaggugacacagccugggacuuuggaucccugggaggagugcuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagaggguauuuguggaauccgcucaguaacaagauuggagaaucugauguggaagcaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagacuuuucuuauugauggcccugaaacagcagaaugccccaacacaaacagagcuuggaacucgcuggaaguugaagacuaugguuuuggaguuuucaccaccaauauauggcugaaauugagagaaaagcaggauguauuuugugacucaaaacucaugucagcagccaucaaagacaacagagccguucaugccgauauggguuauuggauagaaagugcacucaaugacacauggaagauggagaaagccuccuuuauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaaccuuugcagcuggacuacucuugagaaaacugacuuccaaggaauugaugauggccaccauaggaauagcacuccuuucccaaagcaccauaccagagaccauucuugaacugacugaugcgcuagccuugggcaugaugguccucaaaauagugagaaauauggaaaaauaccaacuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaucuccauccaggagcaggaaagacaaaaagauaucuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauagucuugcucauuccagaaccagaaaaacagagaacaccccaagacaaccaguugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggauauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuucuaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaaucacggcagaguggcuuuggaaagaacuaggaaagaaaaagacacccaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugagcuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6591 - RNA, 9876 nt, Artificial Sequence
  derived and/or modified CDS sequence (wt) from DENV-2__FJ744743__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacaggaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuuguggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacgcugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcguuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcaacucuucuucguuuuguagcacaguaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccauagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6592 - RNA, 9876 nt, Artificial Sequence
  derived and/or modified CDS sequence (wt) from DENV-2__JN819424__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcguccagcauagacaacagagccguucaugccgauauggguuauuggauggaaagugcacccucugauucaugcaagauggagaaagccuccuucauugaagauaaaagcugcuacuggccaaauucacaacaccuguggagcaauggaguauuagaaagugagaugauauucccaaaaaauuuugccgggccagugucacaacacaucuacagaccaggcuaccacacacaaacagcaggaccuugcaaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaagccauugauggugaauaccgauugagaggggaagcaaggaaaaccuuuguggaccuaaugagaagaggggacuuaccagucagguuggccuacaaaguggcagcugaaggcaucaauuacgcagacagaaagugguguuuugauggaauuaagaacagccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaucaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacagcaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6593 - RNA, 9876 nt, Artificial Sequence
  derived and/or modified CDS sequence (wt) from DENV-2__FJ744741__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuauugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaaacauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcacuucacugucugugucguuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucacgcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggagggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugacugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuauaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaguuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggagguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgaaccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacaucuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaucaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaaaaacauccaaacagcaauaaaucaagucagaucccuuauaggcaaugaggaauacacagacuacaugccauccaugaagagauuuagaagggaagaggaagaggcagguguccugugguag

SEQ ID NO: 6594 - RNA, 9876 nt, Artificial Sequence
  derived and/or modified CDS sequence (wt) from DENV-2__FJ744703__SS-prME
acagcaggcgugauugugauguugauuccaacagcgauggcguuccaucuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaacggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaauccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauuccaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcagggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacagugauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6595 - RNA, 9876 nt, Artificial Sequence
  derived and/or modified CDS sequence (wt) from DENV-2__FJ850067__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauauaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuugcuguucacaggacaucucaagugcaggcugagaauggacaaacuacagcucaaaggaaugucauacuccauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggcuaccauaggaaucgcacuccuuucccaaagcaccauaccagagaccauucuagaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccaccagaguaguggcagcugaaauggaggaagcucuuagaggacuuccaauaagauaccaaacuacagcuaucaaaaccgaacauaccgggcgggagaucguggaccuaaugugucaugccacauuuacuaugaggcuguuaucaccagucagagugccaaauuacaaccugaucaucauggacgaagcccacuuuacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaagcauaaaagcaggaaaugauauagcagcuugucuuaggaaaaauggaaagaaagugauacaacucaguaggaagacuuuugacucugaguauguuaagacuagagccaaugauugggacuuuguggucacgacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaauaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggauuuauucugacccacuggcacuaaaagaauucaaggaauuugcagcuggaagaaaaucuuugacccugaaccuaauuacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacacuugucacaccaauguugagacacagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacccucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaccauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaauuuagugcgucugcaaaguggaguugacguuuucuucaccccgccagaaaagugugaaacauuguugugugacauaggggagucgucaccaaaucccacgauagaagcaggacgaacacucagaguccucaacuuaguggaaaauugguugaacaauaacacccaauucugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauaggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaauuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaacuugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6596 - RNA, 9876 nt, Artificial Sequence
  derived and/or modified CDS sequence (wt) from DENV-2__FJ850060__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguauuguauagaagcaaagcugaccaauacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcaugcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggauaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacaguuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagacuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagacuugggaagagugaugguuauggugggcgcuaccaugacggaugacauagguaugggagugacuuaucuugcccuacuagcagcuuuuaaaauuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcgcaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagccgccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagcuuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuagcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagauccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuugugguuacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaggaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaagcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugaccuugggaauguguugcauaaucacagcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuaguaaggaauccacucucacgaaacuccacgcaugaaauguacuggguaucuaaugccaccgggaacauagugucaucagugaacaugaucucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuuucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagccgaacaaccugguccauacacgcuaagcaugaauggaugacgacggaagacaugcuggcagucuggaacaggguguggauccaaggaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6597 - RNA, 9876 nt, Artificial Sequence
  derived and/or modified CDS sequence (wt) from DENV-2__FJ850061__SS-prME
acagcaggcgugauuauuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuacgggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacauuuccaaagggccuugauuuucaucuuacugacagcagucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccaugguuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugcgacaacaaugagaggagcaaagagaauggccauuuuaggugacacagccugggacuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaagucaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuuuaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucgcaagucaagccuauaacuuucacggcagcucuucuuuuauugguagcccauuaugccauuauagggccaggucuucaagcaaaagcacccagagaagcucagaaaagagcagcagcaggcaucaugaaaaauccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaagcggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacucuacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagguaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauuacugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcaggugucuugugguag

SEQ ID NO: 6598 - RNA, 9876 nt, Artificial Sequence
  derived and/or modified CDS sequence (wt) from DENV-2__FJ744709__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaguucuggcauacaccauaggaacgacacauuuccaaaaggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaccagacuuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaaggacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggccucaauccaacagccauuuuucuaacaacucuuucgagaaccagcaaaaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacaauaucagaagauggcagcaugucgauaaaaaaugaagaggaagaacaaacacugaccauacuuaucagaacgggauuguuggugaucucaggaaucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaagaguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccccuugaaaaugaugaagacugugcacauuggaaagaagccaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacuaugggaaggaaauccagggagguuuuggaauacuaccauugcagugucaauggccaacaucuuuagggggagcuacuuggccggagcuggacuucucuuuucuaucaugaaaaacacaacaagcacaagaagaggaacuggcaacauaggagagacacuuggagaaaaauggaaaagucgauuaaacgcacuagggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaucacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaggaaaaagacacccaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagagaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6599 - RNA, 9876 nt, Artificial Sequence
  derived and/or modified CDS sequence (wt) from DENV-2__FJ744708__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagcuaguucucuccuaaagaaugauauucccaugacagguccauuaguggcuggagggcuccuuaccguauguuaugugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcacacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcagagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuagacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucgcaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggucaacaucuuuagcgggagcuacuuggccggagcuggacuacacgucccgcuccggaaaaacacacuccgcacaagaagaggaaccggcaacacaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6600 - RNA, 9876 nt, Artificial Sequence
  derived and/or modified CDS sequence (wt) from DENV-2__FJ810418__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaaaggaggcaucgugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuuaagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucgucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugguaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauaggcaugggagugacuuaucuugcccuacuagcagcuuuuaaaguuagaccaacuuuugcagcuggacuacucuugagaaaacugacuuccaaggaauugaugauggccaccauaggaauagcacuccuuucucaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccucccagccauaguuagagaagcuauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggacuuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucucuacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccagaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagaguagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6601 - RNA, 9876 nt, Artificial Sequence
  derived and/or modified CDS sequence (wt) from DENV-2__FJ639835__SS-prME
acagcaggugugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugccauguuuacaugcaaaaagaacauggaaggaaaagucgugcagccagaaaacuuggaguacaccaucgugauaacaccacacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcuaagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagccauccaaaaagcucaugaagagggcauuuguggaauccgcucaguaacaagauuggagaaucugauguggaaacaaauaacaccagaauugaaucauauucuaucagaaaaugagguaaaauugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugguaaucccaaaaaauuuugccgggccagugucacaacacaacuacagaccaggcuaccauacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacgauaucagaagauggcagcaugucgauaaaaaaugaagaggaagaacaaacacugaccauacuuaucagaacgggauuguuggugaucucaggagucuuuccaguaucgauaccaaucacggcagcagcaugguaccugugggaaguaaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaucaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggaaacccuggagacacugcuucuacugacacuccuggcaacagucacaggaggaaucuucuuauucuuaaugaguggaaaaaguauagggaagaugacccugggaauguguugcauaaucacggcuagcauccuccuauggcaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggauauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaagugaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucgacauauggguggaaucuagugcgucugcaaaguggaguugacguuuucuucaccccgccggaaaagugugacacauugcugugugacauaggggagucgucaccaaaccccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaaaugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauagguaaugaggaauacacagauuacaugccauccaugaagagauucagaagggaagaggaagaggcagguguccugugguag

SEQ ID NO: 6602 - RNA, 9876 nt, Artificial Sequence
  derived and/or modified CDS sequence (wt) from DENV-2__FJ850050__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacagggggcacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucauuacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaauacaacagagccguucaugccgauauggguuauuggauagaaagugcgcccugugacucgugggagaugcagaaagccuccuucauugaaguuauaagcugccacuggccaaagucacucacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcgcucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggaaucaauuacgcagacagaaagugguguuuugauggaauuaagaacaaccaaauacuggaagaaaauaugcaagagcaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuuuaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcaggaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6603 - RNA, 9876 nt, Artificial Sequence
  derived and/or modified CDS sequence (wt) from DENV-2__FJ639837__SS-prME
acagcaggugugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugccauguuuacaugcaaaaagaacauggaaggaaaagucgugcagccagaaaacuuggaguacaccaucgugauaacaccacacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcuaagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagccauccaaaaagcucaugaagagggcauuuguggaauccgcucaguaacaagauuggagaaucugauguggaaacaaauaacaccagaauugaaucauauucuaucagaaaaugagguaaaauugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugguaaucccaaaaaauuuugccgggccagugucacaacacaacuacagaccaggcuaccauacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacgauaucagaagauggcagcaugucgauaaaaaaugaagaggaagaacaaacacugaccauacuuaucagaacgggauuguuggugaucucaggagucuuuccaguaucgauaccaaucacggcagcagcaugguaccugugggaaguaaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggaaacccuggagacacugcuucuacugacacuccuggcaacagucacaggaggaaucuucuuauucuuaaugaguggaaaaaguauagggaagaugacccugggaauguguugcauaaucacggcuagcauccuccuauggcaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggauauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagcuccaauacccuaugauccaaaauuugaaaagcaguuaggacaagugaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucgacauauggguggaaucuagugcgucugcaaaguggaguugacguuuucuucaccccgccggaaaagugugacacauugcugugugacauaggggagucgucaccaaaccccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaaaugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacguggccaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauagguaaugaggaauacacagauuacaugccauccaugaagagauucagaagggaagaggaagaggcagguguccugugguag

SEQ ID NO: 6604 - RNA, 9876 nt, Artificial Sequence
  derived and/or modified CDS sequence (wt) from DENV-2__FJ744706__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaacagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccguguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagggucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggugccguaucucuagacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggacuuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuucuuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucucuacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaccucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaggcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaacuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6605 - RNA, 9876 nt, Artificial Sequence
  derived and/or modified CDS sequence (wt) from DENV-2__FJ744707__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggaugguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaauacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuggaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagccccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6606 - RNA, 9876 nt, Artificial Sequence
  derived and/or modified CDS sequence (wt) from DENV-2__FJ744704__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugaucuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucuuaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuagaaaaaagacacguauuaggucgcuugauuacaguuaacccaaucguaacagaaaaagauagcccagucaacauagaagcagaaccuccauucggagauagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaauuuauggggcugcuuuuaguggggucucauggacuaugaaaauccucauaggagucaucaucacauggauaggaaugaauucacguagcaccucacugucugugucgcuaguauuggugggugucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggacccuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuuaagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugauauucccaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauguucaaaaccaacaccggaaccauaggcgccguaucucuggacuuuuccccuggaacgucaggaucuccaauugucgacagaaaaggaaaaguugugggucuuuacgguaaugguguugucacaagaaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaacugagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagggaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuugugguuacaacugacaucucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaagaaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggaaacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugacuuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggaaucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauauguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagagaacucccugaguggaguggaaggagaagggcugcacaggcuaggcuacauuuuaagagacgugggcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacagcaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaacgccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaaaaacauccaaacagcaauaaaucaagucagaucccuuauaggcaaugaggaauacacagacuacaugccauccaugaagagauucagaagggaagaggaagaggcagguguccugugguag

SEQ ID NO: 6607 - RNA, 9876 nt, Artificial Sequence
  derived and/or modified CDS sequence (wt) from DENV-2__FJ744745__SS-prME
acagcaggcgugauuguuauguugauuccaacagcgauggcguuccauuuaaccacacgcaauggagaaccacacaugaucguugguaggcaggagaaagggaaaagucuucuauucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugaaaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccuaggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacucgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugauauucccaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccauuaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagccagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgagugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguacccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuuaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagggaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccagcgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguagucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaacuaggggaauucggcaaggcaaaagguagcagagccauaugguacauguggcuuggagcacgcuucuuagaguuugaagcccuaggauuccuaaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccauguagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6608 - RNA, 9876 nt, Artificial Sequence
  derived and/or modified CDS sequence (wt) from DENV-2__FJ744705__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcagccagaaaauuuggaauacaccaucgugauaacaccccacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgauucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcauugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacaguagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuuaagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaucaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugauauucccaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuaccaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcgugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagagaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaauacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggagagucgucaccaaauccuacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgaggagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6609 - RNA, 9876 nt, Artificial Sequence
  derived and/or modified CDS sequence (wt) from DENV-2__FJ744744__SS-prME
acagcaggcgugauuguuauguugauuccaacagcgauggcguuccauuuaaccacacgcaauggagaaccacacaugaucguugguaggcaggagaaagggaaaagucuucuauucaaaacagaggacgguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugaaaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggugucucauggacuaugaaaauccucauaggagucaucaucacauggauaggaaugaauucacguagcaccucacugucugugucgcuaguauuggugggcguugugacacuguaccuaggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacucgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcaguuggacuacucuuaagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagugguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugauauucccaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagccagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgagugaucuuggcaggaccuaugccggugacccacucuagugcagcgcaaagaagagggagaauaggaagaaauccaaaaaaugaaaaugaccaguacauauacaugggggaaccucuugaaaaugaugaaaacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuuaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccagcgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccuaaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgcgaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccauguagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6610 - RNA, 9876 nt, Artificial Sequence
  derived and/or modified CDS sequence (wt) from DENV-2__GQ868646__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaaaggaggcauugugaccugugcuaaguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuaucgauggcccugaaacagcagaaugccccaacacaaacagagccuggaacucgcuggaaguugaagacuaugguuuuggaguuuucaccaccaauauauggcugaaauugagagauaaacaggauguauuuugugacucaaaacucaugucagcggccauuaaagacaacagagccguucaugcugauauggguuauuggauagaaagugcacucaaugacacauggaagauggagaaagccuccuucauugaagucaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguaugggauggaaaucagaccauugaaagagaaagaagagaauuuggucaacuccuuggucacagccggacaugggcagauugacaacuuuucacuaggagucuugggaauggcacugcuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcugggcuacucuuaagaaaacugaccuccaaggaauugaugauggccaccauaggaaucgcacuccuuucccaaagcaccauaccagaaaccauucuugaacugacugaugcauuagcccugggcaugaugguccucaaaauagugagaaauauggaaaaauaccaauuggcagugacugucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacgauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugcgcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaauauggacaaaagaaggggaaaggaaaaaguuaaaacccagaugguuggaugcuaggaucuauucugacccacuagcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccggacccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaggaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaagcaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaaggaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucauugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauuuagaagggaagaggaagaggcagguguccugugguag

SEQ ID NO: 6611 - RNA, 9876 nt, Artificial Sequence
  derived and/or modified CDS sequence (wt) from DENV-2__FJ906961__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggagguauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuucggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagccucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggaaguauuuugugacucaaaacucaugucagcagccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggacccuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucucaaagcaccauaccagagaccauucuugaacugacugaugcauuagcccugggcaugaugguccucaaaauagugagaaacauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuucuccuggaacgucaggaucuccaaucgucgacagaaaaggaaaaguugugggucuuuacgguaaugguguugucacaagaaguggagcauauguaagugcuauagcccagaccgaaaaaagcauugaagacaauccagagaucgaagaugauauuuuccgaaagaaaagauugaccaucauggaccuccauccaggagcaggaaagacaaaaagauaccuuccagccauaguuagagaagccauaaaacguggcuugagaacacugauccuggcucccacuagaguaguggcagcugaaauggaggaagcucuuagaggacuuccaauaagauaccaaaccacagcuaucaaaaccgagcauacugggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuagaaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugauccuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugccaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6612 - RNA, 9876 nt, Artificial Sequence
  derived and/or modified CDS sequence (wt) from DENV-2__FJ906962__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaaucuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugaaacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuauaccugggagcuauggugcaagcugauagugguuguguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagauaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggaguccugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcggcuuuuaaaguuagaccaacuuuugcagcuggacuacucuuaagaaaacugaccuccaaggaauugaugauggccaccauaggaaucgcacuccuuucccaaagcaccauaccagagaacauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccgucucaccacugcucuuaacauccucacagcagaaagcggauuggauaccacuggcauugacgauaaaaggucucaauccaacagccauuuuuuuaacaacucucucgagaaccagcaagaaaaggagcuggccgcuaaaugaagcuaucauggcaguugggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacggaaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaacuuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucuuuuuuccaucaugaaaaacacaacaaacacaagaagaggaacuggcaacauaggagagacacuuggagaaaaauggaaaagucgauuaaacgcacugggaaaaagugaauuucaaaucuauaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuugaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauagaagcccaauuaauuagacagauggagggagaaggaaucuucaaaagcauucaacaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauuggacuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6613 - RNA, 9876 nt, Artificial Sequence
  derived and/or modified CDS sequence (wt) from DENV-2__FJ850053__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggagguauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuucggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagccucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggacccuggcaucuagguaagcuugagauggacuuugaucuuugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucucaaagcaccauaccagagaccauucuugaacugacugaugcauuagcccugggcaugaugguccucaaaauagugagaaacauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugauauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacucccaauaagauaccaaaccacagcuaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuagaaaaaauggaaagaaagugauacaacucaguagaaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugauccuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguagaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugccaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaaggcagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6614 - RNA, 9876 nt, Artificial Sequence
  derived and/or modified CDS sequence (wt) from DENV-2__JN819420__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacagccugccacucuaaggaaguacugcauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaauccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagacuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaauacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagagagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcggcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauagcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaccuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccaugggaugcuauucacaauucaagccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauugaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6615 - RNA, 9876 nt, Artificial Sequence
  derived and/or modified CDS sequence (wt) from DENV-2__FJ850118__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcaccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguucuaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacggccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggauaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuuaagaaaacugaccuccaaggaauugaugauggccaccauaggaaucgcacuccuuucccaaagcaccauaccagagaccauucuugaacugacugaugcguuagcccugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucucucgagaaccagcaagaaaaggagcuggccgcuaaaugaagcuaucauggcaguugggauggugagcauuuuagccaguucucuccuaaagaaugauauucccaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuagaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6616 - RNA, 9876 nt, Artificial Sequence
  derived and/or modified CDS sequence (wt) from DENV-2__JN819416__SS-prME
acagcaggcgugauuguuauguugauuccaacagcgauggcguuccauuuaaccacacgcaauggagaaccacacaugaucguugguaggcaggagaaagggaaaagucuccuguucaaaacagaggaugguguuaacauguguacccucauggccauagaccuuggugaauuaugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacccuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaagauugugaaggaaauagcagaaacacaacauggaacaauaguuaucagaguacaauaugaaggggacgguucuccauguaagaucccuuuugagauaacagauuuggaaaaaagacacgucuuaggucgcuugauuacagucaacccaaucguaacagaaaaagauagcccagucaacauagaagcagaaccuccauuuggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucucauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccagguuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggauuacucuugagaaaacugaccuccaaggaauugaugauggccaccauaggaaucgcacuccuuucccaaagcaccauaccagagaccauucuugaacugacugaugcgcuagccuugggcaugaugguccucaaaauagugagaaauauggaaaaauaccaauuggcagugacuaucauggcuauuucgugcgucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucaaauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaucaguacauauacaugggggaaccucuugaaaaugaugaagacugugcacauuggaaagaagcuaaaaugcuccuagauaacaucaacacacccgaaggaaucauucccaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaauaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaauuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucacuaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaucauuuucaugaguuagucaugaaagauggucgcgugcucguagucccaugcagaaaccaagaugaacuaauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6617 - RNA, 9876 nt, Artificial Sequence
  derived and/or modified CDS sequence (wt) from DENV-2__FJ850119__SS-prME
acagcaggcgugauuguuauguugauuccaacagcgauggcguuccauuuaaccacacgcaauggagaaccacacaugaucguugguaggcaggagaaagggaaaagccuccuguucaaaacagaggaugguauuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcgaugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaaucuccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucucauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccacuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuggauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccucagaagaaaccgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6618 - RNA, 9876 nt, Artificial Sequence
  derived and/or modified CDS sequence (wt) from DENV-2__FJ850064__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagacacaaucacguacaaguguccucuccucagacaaaaugaaccagaagacauagauuguuggugcaacucuacguccacauggguaacuuacgggacauguaccaccacaggagaacacagaagagaaaaaagaucaguggcgcucguuccacauguggguaugggacuggagacacgaacugaaacauggaugucaucagaaggggccuggaagcauguucagagaauugaaaccuggaucuugagacauccaggcuuuaccauaauggcagcaauccuggcauacaccauaggaacgacacauuuccaaagggccuugauuuucaucuuacugacagcagucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccaugguuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugcgacaacaaugagaggagcaaagagaauggccauuuuaggugacacagccugggacuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaagucaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucucgggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacucuacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagguaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauuacugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcaggugucuugugguag

SEQ ID NO: 6619 - RNA, 9876 nt, Artificial Sequence
  derived and/or modified CDS sequence (wt) from DENV-2__FJ850065__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauuucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguacagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaacgagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuugguuaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacggguuuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaagacauuuuccgaaagaaaagauugaccaucauggaccuccauccaggagcaggaaagacaaaaagauaccuuccagccauaguuagagaagccauuaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccacagagcaaugcaccaaucauggaugaggaaagagaaaucccugagcguucguggaauucaggacacgaaugggucacggauuuuaagggaaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacauuggauagcagcuucaauaauacuggaguuuuuucucauaguuuugcucauuccagaaccagaaaaacagagaacaccccaagacaaccaauugaccuacguugucauagccauccucacaguaguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcggcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaacauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggaugucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaucacaugaaaggagaacacaagaaacuagccgaggcuauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagagaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaaucucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6620 - RNA, 9876 nt, Artificial Sequence
  derived and/or modified CDS sequence (wt) from DENV-2__FJ873808__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguauuguauagaagcaaagcugaccaauacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcaugcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagauaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggauaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacaguuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagacuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagacuugggaagagugaugguuauggugggcgcuaccaugacggaugacauagguaugggagugacuuaucuugcccuacuagcagcuuuuaaaauuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcgcaauauuggcagcgguguccguuucaccacugcucuuaacauccucaaagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugauauucccaugacagguccauuaguggcuggagggcuccuuaccguauguuacgugcucacuggacgaucggccgauuuggaacuggagagagccgccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuagcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagauccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuugugguuacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaggaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaagcuuccaacuuucaugacucagaaagcaagaaacgcacuggacaacuuggcugugcugcauacggcugaggcagguggaagggcguacaaucaugcucucagugaauugccggagacccuggagacacugcuucuacugacacuccuggcaacagucacaggaggaaucuucuuauucuuaaugagcggaaaagguauagggaagaugaccuugggaauguguugcauaaucacagcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaacgucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccuuaacccauauaugccuucagucauagaaaaaauggaagcauuacaaaggaaauauggaggagccuuaguaaggaauccacucucacgaaacuccacgcaugaaauguacuggguaucuaaugccaccgggaacauagugucaucagugaacaugaucucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuuucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagccgaacaaccugguccauacacgcuaagcaugaauggaugacgacggaagacaugcuggcagucuggaacaggguguggauccaaggaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6621 - RNA, 9876 nt, Artificial Sequence
  derived and/or modified CDS sequence (wt) from DENV-2__FJ850120__SS-prME
acagcaggcgugauuguuauguugauuccaacagcgauggcguuccauuuaaccacacgcaauggagaaccacacaugaucguuggcaggcaggagaaagggaaaagucuucuguucaaaacagaggaugguguuaacauguguacccucauggccauagaccuuggugaauugugugaggauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccgucacagaagcagaacugacaggcuauggcacugucacaauggagugcuccccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacauuaucauaggaguagagccgggacaauugaaacucaauugguuuaagaagggaaguuccaucggucaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccaucaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuguggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuugguuacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuuaagaaaacugaccuccaaggaauugaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcaguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugauauucccaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagacggcagcaugucgauaaaaaaugaagaggaagaacaaacgcugaccauacucaucagaacgggauuguuggugaucucaggagucuuuccaguaucgauaccaauuacggcagcagcaugguaccugugggaagugaagaaacaacgggcuggaguguugugggacgucccuucacccccaccaguggaaaaagccaaacuggaggauggagccuacagaaucaagcaaagggggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaaacauugaagacaauccagagaucgaagaugacauuuuccgaaagaaaagauugaccauuauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgagugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccacugucaaagauggacauuggaguuccucuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugugugacucaaguauuaaugaugaggacuacaugggcuuugugugaggcucuaacccuagcgaccgggcccaucuccacacugugggaaggaaacccagggagguuuuggaacacuaccauugcagugucaauggcuaacaucuuuagggggagcuacuuggccggagcuggacuucucuuuuccaucaugaaaaacacaacaaacacaagaagaggaacuggcagcauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaaaugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaagguacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagauaguagguuuugggagcugguugacagggaaagaaaccuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugacuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccauguagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6622 - RNA, 9876 nt, Artificial Sequence
  derived and/or modified CDS sequence (wt) from DENV-2__FJ850121__SS-prME
acagcaggcgugauuguuauguugauuccaacagcgauggcguuccauuuaaccacacgcaauggagaaccacacaugaucguugguagacaggagaaagggaaaagucuucuguucaaaacagaggaugguguuaacauguguacccucauggccauagaccuuggugaauugugugaagauacaaucacguacaagugcccucuccucagacaaaaugaaccagaagacauagauuguuggugcaacucuacguccacauggguaacuuacgggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcagucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuauuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugaaauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugaaacaacaaugagaggagcaaagagaauggccauuuuaggugacacagccugggacuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaagucaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacauguaacacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcuuuuaacauccucacagcagaaagcggauuggauaccacuggcauugacgauaaaaggucucaauccaacagccauuuuucuaacaacucuuucgagaaccagcaagaaaaggagcuggccgcuaaaugaggcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagcuacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuaugguaaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaaguagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6623 - RNA, 9876 nt, Artificial Sequence
  derived and/or modified CDS sequence (wt) from DENV-2__GQ199897__SS-prME
acagcaggcgugauuguuauguugauuccaacagcgauggcguuccauuuaaccacacgcaauggagaaccacacaugaucguugguaggcaggagaaagggaaaagucuccuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuacgggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcagucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacacuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauagauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaagucaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggaccuucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgccaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguugguggucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgagggaaucaucccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaaucaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccguugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcacugggaaaaagugaauuucaaaucuacaagaaaaguggaauccaggaaguggauagaacccuagcaaaagaagguaucaaaagaggagaaacggaccaccaugccgugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaucacaugaaaggagaacacaagaaacuagccgaggccauauucaaauuaacguaccaaaacaagguggugcgugugcaaagaccaacaccaagaggcacaguaauggacaucauaucgagaagagaccaaagaggcagugggcaagucggcaccuauggccuuaacacuuucaccaauauggaagcccaauuaauuagacagauggagggagaaggaaucuucaaaaguauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6624 - RNA, 9876 nt, Artificial Sequence
  derived and/or modified CDS sequence (wt) from DENV-2__GQ199895__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguugguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuugguuaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagcuuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaagacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagccgggauuuuuaugacagccacuccuccgggaaguagagacccauuuccacagagcaaugcaccaaucauggaugaggaaagagaaaucccugagcguucguggaauucaggacacgaaugggucacggauuuuaagggaaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcggcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggaugucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaucacaugaaaggagaacacaagaaacuagccgaggcuauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgccacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6625 - RNA, 9876 nt, Artificial Sequence
  derived and/or modified CDS sequence (wt) from DENV-2__FJ898478__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcagacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaaccuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucuuucgagaaccagcaagaaaaggagcuggccgcuaaaugaagcuaucauggcagucgggauggugagcauuuuagccaguucucuccuaaagaaugauauucccaugacagguccauugguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggaugucccuucacccccaccaguggaaaaagccgaacuggaggauggagccuacagaaucaagcaaagagggauucuuggauauucucagauaggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugccaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacauaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6626 - RNA, 9876 nt, Artificial Sequence
  derived and/or modified CDS sequence (wt) from DENV-2__GQ199869__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacauacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaauugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcacgaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguucugugguag

SEQ ID NO: 6627 - RNA, 9876 nt, Artificial Sequence
  derived and/or modified CDS sequence (wt) from DENV-2__JX079688__SS-prME
acagcaggcgugauugugauguugauuccaacagcgauggcguuccauuuaaccacacgcaauggagaaccacacaugaucguugguaggcaggaaaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaaaggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagcgcagcgcaaagaagagggagaauaggaagaaauccaaaaaaugaaaaugaccaguacauauacaugggggaaccccuugaaaaugaugaagacugugcacauuggaaagaagcuaaaaugcuccuggauaacaucaauacacccgaaggaaucauuccuaguauguucgaaccggagcgugaaaaaguggaugccauugauggugaauaccguuugagaggggaagcaaggaaaaccuuuguggacuuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuauggcaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucucuacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccagaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcauugaggaauacacagacuacaugccauccaugaagagauucagaagggaagaggaagaggcagguguccugugguag

SEQ ID NO: 6628 - RNA, 9876 nt, Artificial Sequence
  derived and/or modified CDS sequence (wt) from DENV-2__JF357906__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaguucuggcauacaccauaggaacgacacauuuccaaaaggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaccagacuuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaaggacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggccucaauccaacagccauuuuucuaacaacucuuucgagaaccagcaaaaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcaguccaauccugucaauaacaauaucagaagauggcagcaugucgauaaaaaaugaagaggaagaacaaacacugaccauacuuaucagaacgggauuguuggugaucucaggaaucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaagaguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccccuugaaaaugaugaagacugugcacauuggaaagaagccaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccucaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacuaugggaaggaaauccagggagguuuuggaauacuaccauugcagugucaauggccaacaucuuuagggggagcuacuuggccggagcuggacuucucuuuucuaucaugaaaaacacaacaagcacaagaagaggaacuggcaacauaggagagacacuuggagaaaaauggaaaagucgauuaaacgcacuagggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaucacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaggaaaaagacacccaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagagaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguacauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6629 - RNA, 9873 nt, Artificial Sequence
  derived and/or modified CDS sequence (wt) from DENV-2__HQ705624__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaaaggaggcauugugaccugugcuaaguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcuaagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaaggucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaacaaagaacugaaauguggcagcgggaucuucaucacagauaacguacacacauggacagaacaauauaaguuccaaccagaauccccuucaaaacuagcuucagcuaucaaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuaucgauggcccugaaacagcagaaugccccaacacaaacagagccuggaacucgcuggaaguugaagacuaugguuuuggaguuuucaccaccaauauauggcugaaauugagagauaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguagugacugaggacuguggaaauagaggacccucuuuaagaacgaccacugccucuggaaaacucauaacagaauggugcugccgauccugcacacuaccaccucuaagauacagaggugaggauggaugcugguaugggauggaaaucagaccauugaaagagaaagaagagaauuuggucaacuccuuggucacagccggacaugggcagauugacaacuuuucacuaggagucuugggaauggcacugcuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcugggcuacucuuaagaaaacugaccuccaaggaauugaugauggccaccauaggaaucgcacuccuuucccaaagcaccauaccagaaaccauucuugaacugacugaugcauuagcccugggcaugaugguccucaaaauagugagaaauauggaaaaauaccaauuggcagugacugucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuucccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuagaaaaaauggaaagaaagugauacaacucagcaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugcgcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaacuuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaauauggacaaaagaaggggaaaggaaaaaguuaaaacccagaugguuggaugcuaggaucuauucugacccacuagcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccggacccaucuccacacugugggaaggaaauccagggagguuuuggaacacuaccauugcagugucaauggcuaacaucuuuagggggagcuacuuggccggagcuggacuucucuuuuccauuaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaggaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaauacccaauuuugcauaaagguccucaacccauauaugccuucagucauagaaaaaauggaagcauuacaaaggaaauacggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaagcaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucauugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacaaaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaccaagucagaucccuuauaggcaaugaggaauacacagacuacaugccauccaugaagagauuuagaagggaagaggaagaggcagguguccugugguag

SEQ ID NO: 6630 - RNA, 9876 nt, Artificial Sequence
  derived and/or modified CDS sequence (wt) from DENV-2__HQ705625__SS-prME
acagcaggcgugauugugauguugauuccaacagcgauggcguuucauuuaaccacacgcaauggagaaccacacaugaucguugguaggcaggaaaaagggaaaagucuucuguucaaaacagaggaugguguuaacauguguacccuuauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaacagagacuucguagaaggaguuucaggaggaagcuggguugacauagucuuagaacauggaaguugugugacgacgauggcaaaaaacaaaccaacauuggauuuugaacugaugaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguucuaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguaaaaagcugccacuggccaaagucacacacccuuuggagcaauggaguauuggaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuauuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccguuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacucccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagccaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaacuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcucccaacuuucaugacucagaaagcaagaaacgcacuggacaacuuggcugugcugcauacggcugaggcagguggaagggcguacaaucaugcucucagugaacugccggagacccuagagacacugcuucuacugacacuccuggcaacagucacaggaggaaucuucuuauucuuaaugaguggaaaagguauagggaagaugacccugggaauguguugcauaaucacggccaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaaccccauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaaggcauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaauccuacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguauaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6631 - RNA, 9876 nt, Artificial Sequence
  derived and/or modified CDS sequence (wt) from DENV-2__JF730052__SS-prME
acagcaggcgugauugugauguugauuccaacagcgauggcguuucauuuaaccacacgcaauggagaaccacacaugaucguugguaggcaggaaaaagggaaaagucuucuguucaaaacagaggaugguguuaacauguguacccuuauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaacagagacuucguagaaggaguuucaggaggaagcuggguugacauagucuuagaacauggaaguugugugacgacgauggcaaaaaacaaaccaacauuggauuuugaacugaugaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguucuaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuggaaagugagaugauaaucccaaaaaauuuugccgggccagugucacaacacaacuacagaccaggcuaccacacacaaacagcaggaccuuggcaccuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuauuucuggaagaaaugcucaggacccgaauaggaacgaaacaugcaauacugcuaguugcaguaucuuuugugacacugacaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccguuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacucccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaacuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcucccaacuuucaugacucagaaagcaagaaacgcacuggacaacuuggcugugcugcauacggcugaggcagguggaagggcguacaaucaugcucucagugaacugccggagacccuagagacacugcuucuacugacacuccuggcaacagucacaggaggaaucuucuuauucuuaaugaguggaaaagguauagggaagaugacccugggaauguguugcauaaucacggccaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaaccccauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaaggcauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaauccuacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguauaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccucauaggcaaugaggaauacacagacuacaugccauccaugaagagauucagaagggaagaggaagaggcagguguccugugguag

SEQ ID NO: 6632 - RNA, 9876 nt, Artificial Sequence
  derived and/or modified CDS sequence (wt) from DENV-2__EU482748__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagagacaaucacguacaaguguccucuccucagacaaaaugaaccagaagacauagauuguuggugcaacucuacguccacauggguaacuuaugggacauguaccaccacaggagaacauagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcgaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaauacaccaucgugauaacaccccacucaggagaagagcacgcuguagguaaugacacaggaaagcauggcaaagaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuauaucaucauaggaguagagccgggacaauugaaacucaauugguuuaagaagggaaguucuaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguagugaguuggaaaaauaaagaacugaaauguggcagcgggaucuucaucacagauaacguacacacauggacagaacaauauaaguuucaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugaacugaaguacucauggaaaacauggggaaaggcgaaaaugcucuccacagagucucacaaucagaccuuucuuauugauggcccugagacagcagaaugccccaacacaaacagagcuuggaauucgcuggaaguugaagacuaugguuuuggaguuuucaccaccaauauauggcugaaauugagagaaaaacaggauguauuuugugauucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuugagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagccggagucuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacucccccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagaccuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaagcaagaaacgcacuggacaacuuggcugugcugcauacggcugaggcagguggaagggcguacaaucaugcucucagugaacugccggagacccuggagacacugcuuuuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccauuaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugauguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaaaccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaauuguuguacagaauugguuggcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6633 - RNA, 9876 nt, Artificial Sequence
  derived and/or modified CDS sequence (wt) from DENV-2__EU482749__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagacaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaagugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagguucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucuuaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaauuacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaacuaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaguuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaauuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6634 - RNA, 9876 nt, Artificial Sequence
  derived and/or modified CDS sequence (wt) from DENV-2__EU482751__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugauuucugcgaaggaaccacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaagcagcaauaaaucaagucagaucccuuauaggcaaugaggaauacacagacuacaugccauccaugaagagauucagaagggaagaggaagaggcagguguccugugguag

SEQ ID NO: 6635 - RNA, 9876 nt, Artificial Sequence
  derived and/or modified CDS sequence (wt) from DENV-2__GQ868604__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaauuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacgugggcagauugacaacuuuucacuaggaguccugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcggcuuuuaaaguuagaccaacuuuugcagcuggacuacucuuaagaaaacugaccuccaaggaauugaugauggccaccauaggaaucgcacuccuuucccaaagcaccauaccagagaacauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguggagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaacuuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaauuacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuauaagaaaaguggaauccaggaaguggauagaacccuagcaaaagaagguauaaaaagaggagaaacggaccaccaugcugugucgcgagguucagcaaaacugaggugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaagagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6636 - RNA, 9876 nt, Artificial Sequence
  derived and/or modified CDS sequence (wt) from DENV-2__EU482752__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagauagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguuguguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaagcaggauguauuuugugacucaaaacucaugucagcggccauuaaagacaacagagccguucaugcugauauggguuauuggauagaaagugcacucaaugauacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcggcuuuuaaaguuagaccaacuuuugcagcuggacuacucuuaagaaaacugaccuccaaggaauugaugauggccaccauaggaaucgcacuccuuucccaaagcaccauaccagagaacauucuugaacugacugaugcauuagcccugggcaugaugguccucaagauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgagaaccagcaagaaaaggagcuggccgcuaaaugaagcuaucauggcaguugggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagggacccauuuccucagagcaaugcaccaaucauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaacuuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucuuuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuugaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucaacaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6637 - RNA, 9876 nt, Artificial Sequence
  derived and/or modified CDS sequence (wt) from DENV-2__EU482753__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguuacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauacggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuagaaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagaccuuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaaugagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaauggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucaaugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6638 - RNA, 9876 nt, Artificial Sequence
  derived and/or modified CDS sequence (wt) from DENV-2__EU482680__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacggacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguacgggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcgagaaacgcacuggacaacuuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcauuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcagaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagaaaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagcugaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6639 - RNA, 9876 nt, Artificial Sequence
  derived and/or modified CDS sequence (wt) from DENV-2__EU482754__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauggaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggcguugugacacuguaccugggagcuauggugcaagcugauagugguugcguugugagcuggaaaaauaaagaacugaaauguggcagcgggaucuucaucacagauaacauacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguuaaccauuaugacaggagacaucagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauaugggcuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagcuguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccggagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacaugggcuuaccauggcagcuaugaaacaaaacaaacuggaucagcaucaucuauggugaacggaguggucagauugcugacaaaacccugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccucaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugacuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaaguuagaucccuuauaggcaaugaggaauacacagacuacaugccauccaugaagagauuuagaagggaagaggaagaggcagguguccugugguag

SEQ ID NO: 6640 - RNA, 9876 nt, Artificial Sequence
  derived and/or modified CDS sequence (wt) from DENV-2__FJ478455__SS-prME
acagcaggcgugauugugauguugauuccaacagcgauggcguuccauuuaaccacacgcaauggggaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacaguagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaagcagcaauaaaucaagucagaucccuuauaggcaaugaggaauacacagacuacaugccauccaugaagagauucagaagggaagaggaagaggcagguguccugugguag

SEQ ID NO: 6641 - RNA, 9876 nt, Artificial Sequence
  derived and/or modified CDS sequence (wt) from DENV-2__EU482756__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaauaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacaccugaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuagcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguagcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggggcaauguacgccgaugauacagcaggaugggacacaagaaucacacuagaagacuuaaaaaaugaagaaaugguaacgaaccacaugaaaggagaacacaagaaacuagccgaggccauauucaaacuaacguaccaaaacaagguggugcgugugcaaagaccaacaccaagagguacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6642 - RNA, 9876 nt, Artificial Sequence
  derived and/or modified CDS sequence (wt) from DENV-2__EU482757__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacauagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcgaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaauacaccaucgugauaacaccccacucaggagaagagcacgcuguagguaaugacacaggaaagcauggcaaagaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcagacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguagugaguuggaaaaauaaagaacugaaauguggcagcgggaucuucaucacagauaacguacacacauggacagaacaauauaaguuucaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugaacugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuucaccaccaauauauggcugaaauugagagaaaaacaggauguauuuugugauucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuugagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaauaggaacgaaacaugcaauacuguuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaauugaccuccaaggaauugaugauggccacuauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagccggagucuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacucccccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagaccuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagauagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaagcaagaaacgcacuggacaacuuggcugugcuacauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacuacauuugucacaccaauguugagacauagcauugaaaauuccucagugaaugucucccuaacagccauugccaaucaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccauuaugaaaaacacaacaaguacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugauguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccguacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguuuggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaauuguuguacagaacugguuggcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaaguagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6643 - RNA, 9876 nt, Artificial Sequence
  derived and/or modified CDS sequence (wt) from DENV-2__FJ906956__SS-prME
acagcaggcgugauuguuauguugauuccaacagcgauggcguuccauuuaaccacacgcaauggagaaccacacaugaucguugguaagcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacaggaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccuuauaggagucaucaucacauggauaggaaugaauucacguagcaccucacugucugugucgcuaguauuggugggcguugugacacuguaccugggagccauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugguaaucccaaaaaauuuugccgggccagugucacaacacaacuacagaccaggcuaccauacacaaacagcaggaccuuggcaucuaggcaagcuugagauggacuuugaucucugcgaaggaacuacagugguggugacugaggacugugggaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucaagaaccaguaagaaaaggagcuggccgcuaaaugaagcuaucauggcaguugggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacuaugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuuuaugacagccacuccuccgggaaguagagacccauuuccucagagcaaugcaccaaucauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagagagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcauuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagagccagaaaaacagagaacaccccaagacaaccaauugaccuacguugucauagccauccucacagugguggccgcaacuauggcaaacgagauggguuuccuggaaaaaaccaagaaagaccucggauugggaagcauuacaacccaggaaucugagagcaauauccuggauauagaucuacgcccugcaucagcauggacgcuguaugccguggcuacaacauuugucacaccaauguugagacauagcauugaaaauucuucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaggagacggccuguuugggaaagucuuacgcccaaauguggacucugauguacuuccacagacgugaccucagacuggcggcaaaugccauuugcucggcagucccgucacacuggguuccaacaagucgaacaaccugguccauacacgcuaaccaugaauggaugacgacggaagacaugcuggcagucuggaacaggguguggauccaagaaaacccguggauggaagacaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6644 - RNA, 9876 nt, Artificial Sequence
  derived and/or modified CDS sequence (wt) from DENV-2__EU482759__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacaugcaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauaguccuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagaggagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacauuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuucaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgugugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugcuauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauucaaacagcaauaaaucaagucagaucccuuauaggcaaugaggaauacacagacuacaugccauccaugaagagauuuagaagggaagaggaagaggcagguguccugugguag

SEQ ID NO: 6645 - RNA, 9876 nt, Artificial Sequence
  derived and/or modified CDS sequence (wt) from DENV-2__EU482760__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacaugugccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaauuacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauauuggaguuuuuucuuauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagcccugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaauuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6646 - RNA, 9876 nt, Artificial Sequence
  derived and/or modified CDS sequence (wt) from DENV-2__EU482762__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuguuuggaaagggaggcauugugaccugugcuauguuuacaugcaaaaagaauauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugaguugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuacuggauagaaagugcacucaaugacacauggaagauggagaaagccuccuucauugaaguuaaaagcugcuacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgagaaccagcaagaaaaggagcuggccgcuaaaugaagcuaucauggcaguugggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguugguaaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugcuacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacauuaacacacccgaaggaaucauuccuaguauguucgaaccagagcgugaaaaaguggaugccauugauggugaauaccguuugagaggagaagcaaggaaaaccuuuguggaccuaaugagaagaggggacuugccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugaccuugaaccuaaucacagaaauggguaggcuuccaacuuucaugacucagaaagcaagaaacgcacuggacaacuuggcugugcugcacacggcugaggcagguggaagggcguacaaucaugcucucagugaacugccggagacccuggagacacugcuucuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaacgaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcuuguagucccaugcagaaaccaagaugaacuuauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6647 - RNA, 9876 nt, Artificial Sequence
  derived and/or modified CDS sequence (wt) from DENV-2__EU482763__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauggaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauagucaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuuuggagcaaucuauggggcugcuuuuaguggggucucauggacuaugaaaauccucauaggagucaucaucacauggauaggaaugaauucacguagcaccucacugucuguuucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacaucagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauaugggcuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcuuaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguagcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacaaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaaugcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaauacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaacccugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggagaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaaguuagaucccuuauaggcaaugaggaauacacagacuacaugccauccaugaagagauuuagaagggaagaggaagaggcagguguccugugguag

SEQ ID NO: 6648 - RNA, 9876 nt, Artificial Sequence
  derived and/or modified CDS sequence (wt) from DENV-2__EU482444__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauggaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucuucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauuaaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguacuggugggcguugugacacuguaccugggagcuauggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacaucagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauaugggcuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagcuguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuuuaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaauccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaacccugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggaguaauguacgccgaugauacagcaggaugggacacaagaaucacacuagaagacuuaaaaaaugaagaauugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccucaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguaguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaaugguguggcucauugauugggcuaacaagcagggcuaccugggcaaagaacauccaaacagcaauaaaucaaguuagaucccuuauaggcaaugaggaauacacagacuacaugccauccaugaagagauuuagaagggaagaggaagaggcagguguccugugguag

SEQ ID NO: 6649 - RNA, 9876 nt, Artificial Sequence
  derived and/or modified CDS sequence (wt) from DENV-2__EU482684__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcaacaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuaggcaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauauagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggggcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccaugguagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaauaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6650 - RNA, 9876 nt, Artificial Sequence
  derived and/or modified CDS sequence (wt) from DENV-2__EU482685__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaauuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagugggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggaaaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugacuuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguggagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggcgccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagacaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaauccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacuaaugaaaauuacggcagaguggcuuuggaaagaacuaggaaagaaaaagacacccaggauguguaccagagaagaauucacaaaaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaagagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6651 - RNA, 9876 nt, Artificial Sequence
  derived and/or modified CDS sequence (wt) from DENV-2__EU482687__SS-prME
acagcaggcgugauugugaugcugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaguccuggcauacaccauaggaacgacacauuuccaaagggccuugauuuucgucuuacugacagcugucgcuccuucaaugacaaugcgcugcauagggauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaagaauuuugccgggccagugucacaacacaacuacagaccaggcuaccauacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcaguaauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaacccggaaaaaauccaagagccguucaaacgaaaccuggaauuuucaaaaccaacacuggaaccauaggcgccguaucucuggacuuuuccccuggaacaucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacuagaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagacuuuugacucugaguauguuaagacuagagcuaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaacacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccuggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaaugaaacaagagcaugaaauaucauggcacuaugaucaagaccacccauacaaaacgugggcuuaccauggcagcuaugaaacaaaacaaacuggaucagcaucgucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcucuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaagcagcaauaaaucaagucagaucccuuauaggcaaugaggaauauacagacuacaugccauccaugaagagauucagaagggaagaggaagaggcagguguccugugguag

SEQ ID NO: 6652 - RNA, 9876 nt, Artificial Sequence
  derived and/or modified CDS sequence (wt) from DENV-2__EU482688__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaauagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguagugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucucuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagccggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauacggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugugugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaauugacguuuucuucaccccgccagaaaagugugauacauuguugugugacauaggggagucgucaccaaaccccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgaccccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaaaguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucaaugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6653 - RNA, 9876 nt, Artificial Sequence
  derived and/or modified CDS sequence (wt) from DENV-2__EU482691__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagacuuuucuuauugauggcccugaaacagcagaaugccccaacauaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacauacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaagaugggaagaucaggcagaaauaucaggaagcaguccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaagaguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacacagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuucuaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcguaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacacccaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagagugggccgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6654 - RNA, 9876 nt, Artificial Sequence
  derived and/or modified CDS sequence (wt) from DENV-2__EU482693__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacaugugcacccucauggccauagaccuuggugaauugugugaagauacaaucacguacaaguguccucuccucagacaaaaugaaccagaagacauagauuguuggugcaacucuacguccacauggguaacuuaugggacaugcaccaccacaggagaacauagaagagaaaaaagaucaguggcgcucguuccacauguggguaugggacuggagacacgaacugagacauggaugucaucagaaggggccuggaaacauguucagagaaucgaaaccuggaucuugagacauccaggcuuuaccauaauggcagcaauccuggcauacaccauaggaacgacacauuuccaaagggccuugauuuucaucuuacuaacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcgaagcugaccaacacaacaacagaaucacgcugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaauacaccaucgugauaacaccccacucaggagaagagcacgcuguagguaaugacacaggaaagcauggcaaagaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguagugaguuggaaaaauaaagaacugaaaugcggcagcgggaucuucaucacagauaacguacacacauggacagaacaauauaaguuucaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugaacugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuucaccaccaauauauggcugaaauugagagaaaaacaggauguauuuugugauucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuugagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaauuccuuggucacagccggacaugggcagauugacaacuuuucacuaggagucuugggaauggcacuguuccuggaagaaaugcucaggacccgaauaggaacgaaacaugcaacacuacuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugagcugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaagugggaagaucaggcagaaauaucaggaagcagcccaauccugucaauaacaauaucagaagauggcagcaugucgauaaaaaaugaagaggaagaacaaacgcugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagccggagucuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggccugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagcugggauuuuuaugacagccacucccccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagaccuuugacucugaguauguuaagacuagagccaaugauugggacuuuguggucacaacugacauuucagagaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccccuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggauuuauucugacccacuggcacuaaaagaauucaaggaauuugcagcuggaagaaaaucuuugacccugaaccuaaucacagaaauggguaggcuuccaacuuucaugacccagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaaccccauaacucucacagcagcccuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccauuaugaaaaacacaacaagcacaagaagaggaacuggcaacauaggagagacacuuggagaaaaauggaaaagucgauuaaacgcacuaggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugauguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguauuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggaguugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccgcagaagaaaauguuguacagaacugguuggcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6655 - RNA, 9876 nt, Artificial Sequence
  derived and/or modified CDS sequence (wt) from DENV-2__EU596483__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagacuuuucuuauugauggcccugaaacagcagaaugccccaacacaaacagagcuuggaacucgcuggaaguugaagacuaugguuuuggaguuuucaccaccaauauauggcugaaauugagagaaaagcaggauguauuuugugacucaaaacucaugucagcggccaucaaagacaacagagccguucaugccgauauggguuauuggauggaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccacacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugcugauguaaaaugggaagaucaagcagaaauaucaggaagcaguccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggcgcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcacaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaagggaaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggagccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacacagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaguugaccuacguugucauagccauccucacagugguggccgcaaccauggcaaacgagauggguuuccuggaaaaaaccaagaaagaccucggacugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuucuaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacacccaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugcuauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagagacagguguccugugguag

SEQ ID NO: 6656 - RNA, 9876 nt, Artificial Sequence
  derived and/or modified CDS sequence (wt) from DENV-2__EU482597__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaagugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagguucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucuuaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaauuacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaacuaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaguuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaauuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6657 - RNA, 9876 nt, Artificial Sequence
  derived and/or modified CDS sequence (wt) from DENV-2__EU482598__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacggacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggagaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcgagaaacgcacuggacaacuuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacgacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgacuaaacgcauuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcagaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagcuacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagcugaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6658 - RNA, 9876 nt, Artificial Sequence
  derived and/or modified CDS sequence (wt) from DENV-2__EU482603__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacauagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacggaagccaaacaaccugccacucuaaggaaguacuguauagaagcgaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuagaauacaccaucgugauaacaccccacucaggagaagagcacgcuguagguaaugacacaggaaagcauggcaaagaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacagggcaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuauaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguagugaguuggaaaaauaaagaacugaaauguggcagcgggaucuucaucacagauaacguacacacauggacagaacaauauaaguuucaaccagaauccccuucaaaacuagcuucagcuauccaaaaagcucaugcagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugaacugaaguacucauggaaaacauggggaaaggcgaaaaugcucuccacagagucucacaaucagaccuuucuuauugauggcccugagacagcagaaugccccaacacaaacagagcuuggaauucgcuggaaguugaagacuaugguuuuggaguuuucaccaccaauauauggcugaaauugagagaaaaacaggauguauuuugugauucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuugagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagagauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagccggagucuacaaagaaggaacauuccauacaauguggcacgucacacguggugcuguucugaugcacagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauauguaagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacucccccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagaccuuugacucugaguauguuaagacuagagccaaugauugggacuuuguggucacaacugacauuucagaaaugggugccaacuucaaagcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaagcaagaaacgcacuggacaacuuggcugugcugcauacggcugaggcagguggaagggcguacaaucaugcucucagugaacugccggagacccuggagacacugcuuuuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaauuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaggcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccauuaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugauguuuucuucaccccgccagaaaagugugauacauuguugugugacauaggggagucgucaccaaaucccacgauagaagcaggacgaacacucagaguccucaacuuaguggaaaauugguugaacaauaacacccaguuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugaucaacagauucacaaugaaacacaagaaaaccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagauggcagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaauuguuguacagaacugguuggcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaagaauacacagacuacaugccauccaugaagagauucagaagggaagaggaagaggcagguguccugugguag

SEQ ID NO: 6659 - RNA, 9876 nt, Artificial Sequence
  derived and/or modified CDS sequence (wt) from DENV-2__EU482599__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuauugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaaacauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucacgcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucaugguuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaacauggaaguggaaaucuggacaaaagaaggggaaaggaaaaaauuaaaacccagaugguuggaugcuaggaucuauucugacccacuggcacuaaaagaauucaaggaguuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacaucuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6660 - RNA, 9876 nt, Artificial Sequence
  derived and/or modified CDS sequence (wt) from DENV-2__FJ898436__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccaguuuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuucggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggacccuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaagaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuucuggcuacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagcguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaccuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6661 - RNA, 9876 nt, Artificial Sequence
  derived and/or modified CDS sequence (wt) from DENV-2__EU482634__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacauagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcgaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaauacaccaucgugauaacaccccacucaggagaagagcacgcuguagguaaugacacaggaaagcauggcaaagaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguacuugggagcuauggugcaagcugauagugguugcguagugaguuggaaaaauaaagaacugaaauguggcagcgggaucuucauuacagauaacguacacacauggacagaacaauauaaguuucaaccagaauccccuucaaaacuagcuucagcuauccaaaaagcucaugaagagggcauuuguggaauccgcucaguaacaagauuggagaaucugauguggaaacaaauaacaccagaauugaaucauauucuagcagaaaaugagguaaaguugaccauuaugacaggagacauuaaaggaaucaugcaggcaggaaaacgaucuuugcggccccagcccacugaacugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuucaccaccaauauauggcugaaauugagagaaaaacaggauguauuuugugauucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuugagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaauaggaacgaaacaugcaauacuauuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccaacaagaaaaggagcuggccgcuaaaugaagcuaucauggcagucgggauggugagcauuuuagccaguucucuccuaaagaaugauauucccaugacagguccguuaguggcuggagggcuccuuaccguauguuacgugcucacuggacgaucggcugauuuggaacuggagagagcugcugauguaaaaugggaagaucaggcagaaauaucgggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagccggagucuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacucccccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagaccuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugcuguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccaggaagguuuuggaacacuaccauugcagugucaauggccaacaucuuuagggggagcuacuuggccggagcuggacuucucuuuuccauuaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacagaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugauguuuucuucaccccgccagaaaagugugauacauuguugugugacauaggggagucgucaccaaaucccacgauagaagcaggacgaacacucagaguccucaacuuaguggaaaauugguugaacaauaacaccaaauuuugcauaaagguccucaacccauauaugccuucagucauagaaaaaauggaagcauuacaaaggaaauauggaggagcuuuagugaggaauccacucucacgaaacuccacgcaugaaauguacuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccacagaagaaauuguuguacagaacugguuagcaagaguggggcgugaaaggcuaucaagaauggcaaucaguggagaugauuguguuguaaaaccuauagaugacagauuugcaagugcucuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6662 - RNA, 9876 nt, Artificial Sequence
  derived and/or modified CDS sequence (wt) from DENV-2__EU482635__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaagugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagguucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguauugugggacgucccuucacccccaccaguggaaaaagccgaacuggaggauggagccuacagaaucaagcaaagagggauccuuggauauucucagauaggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaauuacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaacuaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaguuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacugguuggcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6663 - RNA, 9876 nt, Artificial Sequence
  derived and/or modified CDS sequence (wt) from DENV-2__GQ199874__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauggaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacaucagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaacccugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6664 - RNA, 9876 nt, Artificial Sequence
  derived and/or modified CDS sequence (wt) from DENV-2__EU482639__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauauaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuugcuguucacaggacaucucaagugcaggcugagaauggacaaacuacagcucaaaggaaugucauacuccauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggcuaccauaggaaucgcacuccuuucccaaagcaccauaccagagaccauucuagaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaaucacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccaccagaguaguggcagcugaaauggaggaagcucuuagaggacuuccaauaagauaccaaacuacagcuaucaaaaccgaacauaccgggcgggagaucguggaccuaaugugucaugccacauuuacuaugaggcuguuaucaccagucagagugccaaauuacaaccugaucaucauggacgaagcccacuuuacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaagggaagacuguuugguuuguuccaagcauaaaagcaggaaaugauauagcagcuugucuuaggaaaaauggaaagaaagugauacaacucaguaggaagacuuuugacucugaguauguuaagacuagagccaaugauugggacuuuguggucacgacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaauaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggauuuauucugacccacuggcacuaaaagaauucaaggaauuugcagcuggaagaaaaucuuugacccugaaccuaauuacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacacuugucacaccaauguugagacacagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagaggaggcuggucauacuauugcgggggacuaaagaauguaagagaagucaaaggccuaacaaaaggaggaccaggacaugaagaacccauccccaugucaacauauggguggaauuuagugcgucugcaaaguggaguugacguuuucuucaccccgccagaaaagugugaaacauuguugugugacauaggggagucgucaccaaaucccacgauagaagcaggacgaacacucagaguccucaacuuaguggaaaauugguugaacaauaacacccaauucugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauaggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaauuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaacuugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6665 - RNA, 9876 nt, Artificial Sequence
  derived and/or modified CDS sequence (wt) from DENV-2__EU482766__SS-prME
acagcaggcgugauugugauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugagacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaguacacuaucgugauaacaccucacucaggagaagagcacgcuguagguaaugacacaggaaagcauggcaaagaaaucaaaauaacaccacagaguuccaucacagaagcagaacugacaggcuauggcaccgucacgauggagugcucuucgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuguggugcaagcugauagugguugcguugugagcuggaaaaauaaagaacugaaauguggcagcgggaucuucauuacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucaccaccaauauauggcugaaauugagagaaaaacaggauguauuuugugacucaaaacucaugucagcggccaucaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugauuucugcgaaggaacuacaguggugguaacugaggacuguggaaauagaggacccucuuuaagaacgaccacugccucuggaaaacucauaacagaauggugcugccgauccugcacacuaccaccucuaagauacagaggugaggauggaugcugguacgggauggaaauuagaccauugaaagagaaagaggagaauuuggucaacuccuuggucacagccggacaugggcagauugacaacuuuucacuaggagucuugggaauggcacuguuucuggaagaaaugcucaggacccgaauaggaacgaaacaugcaauacugcuaguugcaguaucuuuugugacacugauaacugggaacaugucuuuuagagaccugggaagagugaugguuauggugggcgcuaccaugacggaugacauagguaugggagugacuuaucuugcccuacuagcagcuuuuaaaguuagaccaacuuuugcagcuggacuacucuugagaaaacugaccuccaaggaauugaugauggccaccauaggaauagcacuccuuucccaaagcaccauaccagagaccauucuugaacugacugaugcguuagccuugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacuuaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagcuggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaauuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaagaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccccuugaaaaugaugaagacugugcacauuggaaagaagcuaaaaugcuccuagauaacaucaauacacccgaaggaaucauuccuaguauguucgaaccggagcgugagaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggacugggaagcauuacaacccaggaaucugagagcaauauccuggauauagaucuacgcccugcaucagcauggacgcuguaugccguggcuacaacauuugucacaccaauguugagacauagcauugaaaauuccucagugaaugucucccuaacagccaucgcuaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaauacuaccauugcagugucaauggccaacaucuuuagggggagcuacuuggccggagcuggacuucucuuuuccaucaugaaaaacacaacaagcacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccggaaaagugugacacauugcugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggcaauauggaggagccuuagugaggaauccacucucacgaaacuccacgcaugaaauguacuggguaucuaaugccaccgggaacauagugucaucagugaacaugauuucaagaauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaauaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaaguuggcaccuauggccuuaacacuuucaccaauauggaagcccaauuaauuagacagauggagggagaaggaaucuuuaaaagcauucagcaccugacagccacagaagaaaucgcuguacagaacugguuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuccaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6666 - RNA, 9876 nt, Artificial Sequence
  derived and/or modified CDS sequence (wt) from DENV-2__EU482695__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuauugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaaacauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucacgcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugaccaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacguuccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaaccacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaguuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagacccuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugagacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacaucuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaucaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauuuagaagggaagaggaagaggcagguguccugugguag

SEQ ID NO: 6667 - RNA, 9876 nt, Artificial Sequence
  derived and/or modified CDS sequence (wt) from DENV-2__EU482769__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacucucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccagguuuuaccauaauggcagcaauccuggcauacaccauaggaacgacacauuuccaaagggccuugauuuucauuuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaggagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaagcauggcaaggaaaucaaaauaacaccacagagcuccaucacagaagcagaacugacaggcuauggcacugucacgauggagugcucuccgagaacgggccucgacuucaaugagaugguacugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguugucuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccaugcaagaucccuuuugagauaacagauuuggaaaaaagacacgucuuaggucgcuugauuacaguuaacccaaucguuacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcguugugacacuguaccugggagcuauggugcaagcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuagaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagccuggaacucgcuggaaguugaagacuaugguuuuggaguuuucaccaccaauauauggcugaaauugagagaaaaacaggauguauuuugugacucaaaacucaugucagcggccauuaaagacaacagagccguucaugcugauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaagagaauuuggucaauuccuuggucacagccggacaugggcagauugacaacuuuucacuaggagucuugggaauggcacuguuccuggaagaaaugcucaggacccgaauaggaacgaaacaugcaauacugcuaguugcaguaucuuuugugacauugauuacugggaacaugucuuuuagagaccugggaagagugaugguuauggugggcgcuaccaugacggaugacauagguaugggagugacuuaucuugcccuacuagcagcuuuuaagguuagaccaacuuuugcagcuggacuacucuuaagaaaacugaccuccaaggaauugaugauggccaccauaggaaucgcacuccuuucccaaagcaccauaccagagaccauucuugaacugacugaugcauuagcccugggcaugaugguccucaaaauagugagaaauauggaaaaauaccaauuggcagugacuaucauggcuauuucaugugucccaaaugcagugauacugcaaaacgcauggaaggugaguugcacaauauuggcagcgguguccguuucaccacugcucuuaacauccucacagcagaaagcggauuggauaccacuggcauugacgauaaaaggucucaauccaacagccauuuuuuuaacaacucucucgaggaccagcaagaaaaggagcuggccgcuaaaugaagcuaucauggcaguugggauggugagcauuuuagccaguucucuccuaaagaaugauauuccuaugacagguccauuaguggcuggaggacuccucaccguauguuacgugcucacuggacgaucggccgauuuggaacuggagagagcugccgauguaaaaugggaagaucaggcagaaauaucaggaaguagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguacugugggacgucccuucacccccaccaguggaaaaagccgaacuggaggauggagccuacagaaucaagcaaagagggauccuuggauauucucagauuggagccggaguuuacaaagaaggaacauuccauacaauguggcacgucacacguggugcuguucugaugcauagagggaagaggauugaaccaucaugggcagaugucaagaaagaccuaauaucauacggaggaggcuggaagcuagaaggagaauggaaggaaggagaggaaguccaaguccuggcauuggaaccuggaaaaaauccaagagccguccaaacgaaaccuggaauauucaaaaccaacaccggaaccauaggcgccguaucucuggacuuuuccccuggaacgucaggaucuccaaucgucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagaguaguggcagcugaaauggaggaagcucuuagaggacuuccaauaagauaccaaacuacagccaucaaaaccgagcauaccgggcgggagaucguggaccuaaugugucaugccacauuuacuaugaggcuguuaucaccagucagagugccaaauuacaaccugaucaucauggacgaagcccacuucacagacccagcaaguauagcagcuagaggauacauuucaacucgaguagagaugggugaagcagccgggauuuucaugacagccacuccuccgggaaguagagacccauuuccucagagcaaugcaccaauuauggaugaggaaagagaaaucccugagcguucauggaauucaggacacgaaugggucacggauuuuaaggggaagacuguuugguuuguuccaaguauaaaagcaggaaaugauauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcuggaccuaugccagugacccacucuagugcagcgcaaagaagagggagaauaggaagaaauccaaaaaaugaaaaugaccaguacauauacaugggggaaccucuugaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaagcaagaaacgcacuggacaaccuggcugugcugcauacggcugaggcagguggaagggcguacaaucaugcucucagugaacugccggagaccuuggagacacugcuccuacugacacuucuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacauuggaguuccccuccuugccauuggaugcuauucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuuaugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaaaaacacaacaaacacaagaagaggaacuggcaacauaggagagacacuuggagaaaaauggaaaagucgauuaaacgcacuggggaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugcgggggacuaaagaauguaagagaagucaaaggccuaacaaaaggaggaccaggacaugaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauacaugccuucagucauagaaaaaauggaagcauuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccuuuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaaugcagccuugggggccauauucacugaugagaacaaauggaaaucggcacgugaggcuguugaagaugguagguucugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaauaccuucaccaauauggaagcccaauuaauuagacagauggagggagaaggaaucuucaaaagcauucagcaccugacagccacagaagaaaucgcuguacagaacuggcuagcaagaguggggcgugaaaggcuaucaagaauggcaaucaguggagaugauuguguuguaaaacccauagaugacagauuugcaagugcuuuaacagcucuaaaugacaugggaaaaguuagaaaagauauacaacaaugggaaccuucaagaggauggaacgauuggacacaagugccuuucuguucacaccacuuucaugaguuagucaugaaagauggucgcgugcucguagucccaugcagaaaccaagaugaacugauugguagagcccgaauuucccagggagcuggguggucuuugaaagagacggccuguuugggaaagucuuacgcccaaauguggacucugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuugggaaaaagagaagaccaauggugcggcucaaugauugggcuaacaagcagggcuaccugggcaaagaacauccaaacagcaauaaaucaagucagaucccuuauaggcaaugaggaauacauagacuacaugccauccaugaagagauuuagaagggaagaggaagaggcagguguccugugguag

SEQ ID NO: 6668 - RNA, 9876 nt, Artificial Sequence
  derived and/or modified CDS sequence (wt) from DENV-2__EU482696__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaauugugugaggauacaaucacguacaaguguccucuccucagacaaaaugaaccagaagacauagauuguuggugcaacucuacguccacauggguaacuuaugggacaugcaccaccacaggagaacauagaagagaaaaaagaucaguggcgcucguuccacauguggguaugggacuggagacacgaacugagacauggaugucaucagaaggggccuggaaacauguucagagaaucgaaaccuggaucuugagacauccaggcuuuaccauaauggcagcaauccuggcauacaccauaggaacgacacauuuccaaagggccuugauuuucaucuuacuaacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcgaagcugaccaacacaacaacagaaucacgcugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucgugcagccagaaaacuuggaauacaccaucgugauaacaccccacucaggagaagagcacgcuguagguaaugacacaggaaagcauggcaaagaaaucaaaauaacaccgcagaguuccaucacagaagcagaacugacaggcuauggcacugucacgauggagugcucuccgagaacgggccucgacuucaaugagauggugcugcugcagauggaagacaaagcuuggcuggugcacaggcaaugguuucuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacgguucuccauguaagaucccuuuugagauaacagauuuggaaaaaagacacgucuuaggucgcuugaucacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggacuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggcgucgugacacuguaccugggagcuauggugcaagcugauagugguugcguagcgaguuggaaaaauaaagaacugaaaugcggcagcgggaucuucaucacagauaacguacacacauggacagaacaauauaaguuucaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuucaccaccaauauauggcugaaauugagagaaaaacaggauguauuuugugauucaaaacucaugucagcggccauuaaagacaacagagccguucaugccgauauggguuauuggauagaaagugcacucaaugacacauggaagauggagaaagccuccuucauugaaguuaaaagcugccacuggccaaagucacacacccuuuggagcaauggaguauuagaaagugagaugauaaucccaaaaaauuuugccgggccagugucacaacacaacuacagaccaggcuaccauacacaaacagcaggaccuuggcaucuagguaagcuugagauggacuuugaucucugcgaaggaacuacaguggugguaacugaggacuguggaaauagaggacccucuuugagaacgaccacugccucuggaaaacucauaacagaauggugcugccgauccugcacacuaccaccucuaagauacagaggugaggauggaugcugguaugggauggaaauuagaccauugaaagagaaagaggagaauuuggucaauuccuuggucacagccggacaugggcagauugacaacuuuucacuaggagucuugggaauggcacuguuccuggaagaaaugcucaggacccgaauaggaacgaaacaugcaacacuacuaguugcaguaucuuuugugacauugauaacugggaacaugucuuuuagagaccugggaagagugaugguuauggugggcgcuaccaugacggaugacauagguaugggagugacuuaucuugcccuacuagcagcuuuuaaaguuagaccgacuuuugcagcuggacuacucuugagaaaacugaccuccaaggaauugaugauggccaccauaggaaucgcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauacugcaaaacgcauggaaggugagcugcacaauauuggcagcgguguccguuucaccacugcucuuaacauccucacagcagaaagcggauuggauaccacuggcauugacaauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauucccaugacagguccauuaguggccggagggcuccuuaccguauguuacgugcucacuggacgaucggccgauuuggaacuggagagagcugccgauguaaagugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggaguauugugggacgucccuucacccccaccaguggaaaaagccgaacuggaggauggagccuacagaaucaagcaaagagggauucuuggauauucucagauaggagccggagucuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguucaaacgaaaccuggaacuuucaaaaccaacaccggaaccauaggcgccguaucucuggacuuuuccccuggaacgucaggaucuccaauugucgacagaaaaggaaaaguugugggucuuuacggcaaugguguugucacaaggaguggagcauauguaagugcuauagcccagaccgaaaaaagcauugaagacaauccagagaucgaagaugacaucuuccgaaagaaaagauugaccaucauggaccuccauccaggagcaggaaagacaaaaagauaccuuccagccauaguuagagaagccauaaaacguggccugagaacauugauccuggcucccacuagaguaguggcagcugaaauggaggaagcucuuagaggacuuccaauaagauaccaaaccccagccaucaaaaccgagcauaccgggcgggagaucguggaccuaaugugucaugccacauuuacuaugagguugcuaucaccagucagagugccaaauuacaaccugaucaucauggacgaagcccacuucacagacccagcaaguauagcagcuagaggauacaucucaacucgaguagagaugggugaagcagccgggauuuucaugacagccacuccuccgggaaguagagacccauuuccucagagcaaugcaccaaucauggaugaggaaagagaaaucccugagcguucguggaauucaggacacgaaugggucacggauuuuaaagggaagacuguuugguuuguuccaaguauaaaagcaggaaaugauauagcagcuugucuuaggaaaaauggaaagaaagugauacaacucaguaggaagaccuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaacgaaaaugaccaguacauauacaugggggaaccucuugaaaaugaugaagacugugcacauuggaaagaagcuaaaaugcuccuagauaacaucaauacacccgaaggaaucauuccuaguauguucgaaccagagcgugaaaaaguggaugccauugauggugaauaccguuugagaggggaagcaaggaaaaccuuuguggaccuaaugagaagaggggacuuaccagucugguuggccuacaaaguggcagcugaaggcaucaauuacgcagacagaaagugguguuuugauggaauuaagaacaaccaaauacuggaagaaaauauggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacccagaaagcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaauauccuggacauagaucuacgcccugcaucagcauggacgcuguaugccguggcuacaacauuugucacaccaauguugagacauagcauugaaaauuccucagugaaugucucccuaacagccauugccaaccaagcuacagugcuaaugggucuugggaaaggauggccauugucaaagauggacauuggaguuccccuccuugccauuggaugcuauucacaagucaacccuauaacucucacagcagcucuucuucuauugguagcacauuaugccauuauagggccaggacuucaagcaaaagcaaccagagaagcucagaaaagagcagcagcaggcauuaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacacuaccauugcagugucaauggccaacaucuuuagggggagcuacuuggccggagcuggacuucucuuuuccauuaugaaaaacacaacaagcacaagaagaggaacuggcaacauaggagagacacuuggagaaaaauggaaaagucgauuaaacgcacugggaaaaagugaauuucaaaucuacaagaaaaguggaauccaggaaguggauagaacccuagcaaaagaagguaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacaugaagaacccauccccaugucaacauauggguggaaucuagugcgucugcaaaguggaguugauguuuuuuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugccuucagucauagaaaaaauggaagcauuacaaaggaaauauggaggagccuuagugaggaauccacucucacgaaacuccacgcaugaaauguauuggguaucuaaugccaccgggaacauagugucaucagugaacaugauuucaaggauguugaucaacagauucacaaugaaacacaagaaagccacuuacgagccagauguugaccuaggaaguggaacccgcaacauuggaauugaaagugagauaccaaaucuagacauaauaggaaagagaauagagaaaauaaaacaagagcaugaaacaucauggcacuaugaucaagaccacccauacaaaacgugggcuuaccauggcagcuaugaaacaaaacaaacuggaucagcaucaucuauggugaacggaguggucagauugcugacaaaaccuugggacgucgucccuauggugacacagauggcaaugacagacacgacuccauuuggacaacagcgcguuuucaaagagaaaguagacacgagaacccaagaaccgaaggaaggcacaaagaaacugaugaaaauuacggcagaguggcuuuggaaagaacuaggaaagaaaaagacaccuaggauguguaccagagaagaauucacaagaaaagugagaagcaacgcagccuugggggccauauucacugaugagaacaaauggaaaucggcacgugaggcuguugaagaugguagguuuugggaguugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcauaguaauggauaucauaucgagaagagaccaaagaggcagugggcaagucggcaccuauggccuuaacacuuucaccaauauggaagcccaauuaauuagacagauggagggagaaggaaucuucaaaagcauucagcaccugacagccgcagaagaaauuguuguacagaacugguuggcaagaguggggcgugaaaggcuaucaagaauggcaaucaguggagaugauuguguuguaaaaccuauagaugacagauuugcaagugcuuuaacagcucuaaaugacaugggaaaaguuagaaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagcuggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagauaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6669 - RNA, 9876 nt, Artificial Sequence
  derived and/or modified CDS sequence (wt) from DENV-2__KC294207__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacuguauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccgggcuaccauacacaaacagcaggaccugggcaucuagguaagcuugagauggacuuugauuugugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacuuugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaaaaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaagaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguguagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6670 - RNA, 9876 nt, Artificial Sequence
  derived and/or modified CDS sequence (wt) from DENV-2__KC294208__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggagguauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccgggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccacugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggagauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6671 - RNA, 9876 nt, Artificial Sequence
  derived and/or modified CDS sequence (wt) from DENV-2__KC294209__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacaggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguguagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6672 - RNA, 9876 nt, Artificial Sequence
  derived and/or modified CDS sequence (wt) from DENV-2__KC294214__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacuggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggagaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgagccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuucuuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuucuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccauaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccaccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6673 - RNA, 9876 nt, Artificial Sequence
  derived and/or modified CDS sequence (wt) from DENV-2__KC294205__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacaccagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccggacccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacaugguuacaccggaagggaaggugguggaucuugguuguggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacguuguugugugacauaggggagucgucaccaaaucccacgauagaagcaggacgaacacucagaguccucaacuuaguggaaaauuggcugaacacuaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6674 - RNA, 9876 nt, Artificial Sequence
  derived and/or modified CDS sequence (wt) from DENV-2__KC294210__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggagguauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucaugauggaguccuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccgggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaagaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaucacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuaguaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6675 - RNA, 9876 nt, Artificial Sequence
  derived and/or modified CDS sequence (wt) from DENV-2__KC294215__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacaugcaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggagguauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccaggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccgggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaagaagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggaugaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcacaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcaaaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6676 - RNA, 9876 nt, Artificial Sequence
  derived and/or modified CDS sequence (wt) from DENV-2__KC294216__SS-prME
acagcaggagugauuauuauguugauuccaacagcaauggcguuccaucuaaccacacguaauggagaaccacacaugaucguugguaggcaagagaaagggaaaagucuucuguuuaaaacagaggauggugucaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggauccugagacauccaggcuuugccauaauggcagcaauccuggcauacaccauaggaacaacacauuuccaaagagccuugauuuuuaucuuacugacagcugucgcuccuucgaugacaaugcguugcauaggaauaucaaacagagacuucguagaagggguuucaggaggaagcuggguugacauagucuuagaacauggaaguugugugacgacgauggcaaaaaacaaaccaacauuggaucuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcgaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucagggaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauauuaggugacacagccugggauuuuggaucccugggaggaguguuuacaucuauuggaaaggcucuccaccaaguuuucggagcaaucuauggggcugcuuuuaguggggucucauggacuaugaaaauccucauaggagucaucaucacauggauaggaaugaauucacguaguaccucacugucugugucacuaguauuggugggagucgugacacuguaccugggagcuauggugcaggcugauagugguugcguugugagcuggaagaacaaagaauugaaauguggcagcgggauauucauuacagauaacgugcacacauggacagagcaauauaaguuccaaccagaauccccuucaaaacuagcuucagcuauccaaaaagcucaugaagagggcauuuguggaauccgcucagugacaagauuggagaaucugauguggaaacaaauaacaccagaauugaaucacauccuaucagaaaaugagguaaaguugaccauuaugacaggagacaucaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacgaacagagcuuggaacucguuggaaguugaagacuaugguuuuggaguuuuuaccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaagucaaaagcugccacuggccaaagucccacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauacagaggugaggauggaugcugguacgggauggaaaucagaccguugaaagagaaagaggagaauuuggucaacuccuuggucacagccggacaugggcagauugacaacuuuucgcuaggagucuugggaauggcacuguuucuggaagaaaugcucaggacccgaguaggaacgaaacaugcaauacuguuagucgcaguaucuuuuuugacauugaucacugggaacauguccuuuagagacuugggaagagugaugguuauggugggcguugccaugacggaugauauagguaugggagugacuuaccuugcccuauuagcagcuuucaaaguuagaccaacuuucgcagcuggacuacucuugagaaaacugaccuccaaggaauuaaugauggccaccauaggaauuacacuccuuucccaaagcaccacaccagaaaccauucuugaacugacugaugcguuagccuugggcaugaugguccuaaaaauagugagaaauauggaaaaguaccaauuggcagugaccaucaugacuaucucgugugucccaaaugcaaugauacugauaaacgcauggaaggugaguugcacaauauuggcagugguguccguuucuccauugcuccuaacauccucacagcagaaaacggauuggauaccauuggcauugacgauaaaaggucucaauccaacagccaucuuucuaacaacccuuucgagaaccagcaagaaaaggagcuggccgcuaaacgaagcugucauggcagucgggauggugagcauuuuagccaguucucuccuaaagaaugacauuccuaugacagguccauuaguggcuggagggcuccuuacuguguguuacgugcucacuggacgaucggccgauuuggaacuggagagagcugccgaugugaaaugggaagaucaggcagaaauaucaggaagcagcccaauccugucaauaacaauaucagaagauggcagcaugucgauaaagaaugaagaggaagaacaaacacugaccauacucaucagaacgggauugcuggugaucucaggaguuuuuccaguaucgauaccaaucacggcagcagcaugguaccugugggaagugagaaaacaacgggcuggaguauugugggacgucccuucaccuccaccaguggaaaaagccgaacuggaagauggagcuuauagaaucaagcaaagagggauucuuggauauucucagauuggagcuggaguuuacaaagaaggaacauuccacacaauguggcacgucacacguggugcuguucugaugcauagagggaaaaggaucgaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaagaccaacaccggaaccauaggcgccgugucucuggacuuuuccccuggaacgucaggaucuccaauugucgauagaaaaggaaaaguugugggccuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcggcugaaauggaggaagcucuuagaggacuuccaauaagauaccaaaccccagcuaucagagccgagcacaccgggcgggagauuguggaucuaaugugucaugccacauuuacuaugaggcuacuaucaccagucagagugccaaauuacaaccugauuaucauggaugaagcccauuucacagauccagcaaguauagcagcuagaggauauauuucaacucgaguagaaaugggugaagcagcugggauuuucaugacagcuacuccuccgggaaguagagacccauuuccccagagcaaugcaccaaucauggaugaggaaagagaaaucccugagcgcucguggaauucaggacaugaaugggucacagauuuuaaagggaagacuguuugguucguuccaaguauaaaagcaggaaaugacauagcagcuugucucagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccagucauacuaacagauggcgaagagcgagugauuuuggcaggaccuaugccagugacccacucuagugcagcacaaagaagagggagaguaggaagaaauccaaaaaaugaaaaugaccaguacauuuacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugagggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggauaacuuagcugugcugcauacggcugaggcagguggaagggcguacaaucaugcucucagugaacugccggagacccuggagacacugcuuuuacugacacuccuggccacagucacaggaggaaucuucuuauuuuuaaugagcggaaaagguauagggaagaugacucugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggauuccuggaaaaaaccaagagagaccucggacugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuauucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgaugggauaacaguaauugaucuagaaccaauacccuaugauccaaaauuugaaaaacaguuaggacaaguaaugcuccuaauccucugcgugacucaaguauuaaugaugaggacuacaugggcucugugugaggcucuaacccuagcgaccgggcccaucuccacacugugggaaggaaauccagggagguucuggaacacuaccauugcagugucaauggcuaacaucuuuagggggagcuacuuggccggagcuggacuucucuuuuccauuaugaagaacacaacaaacacaagaagaggaacuggcaacauaggagagacacuuggagaaaaauggaaaagccgauuaaacgcacugggaaaaagugaauuucagaucuacaagagaaguggaauccaggaaguggacagaaccuuggcaaaagaaggcaucaaaagaggagaaacggaccaccacgcugugucgcgaggcucagcaaaacugagaugguucgucgagagaaauauggucacaccagaagggaaggugguggaccucgguugcggcagagguggcuggucauacuauugugggggacuaaagaauguaagagaagucaaaggccugacaaaaggaggaccaggacacgaagaacccauccccaugucaacauauggguggaaucuagugcgucugcaaaguggaguugacgucuucuucaccccgccagaaaagugugauacauuguugugugacauaggggagucgucaccaaaucccacgauagaagcaggacggacacucagaguccucaacuuaguggaaaauugguugaacaacaacacccaauuuugcauaaagguucucaacccauauaugcccucagucauagaaaaaauggaaacacuacaaaggaaauacggaggagcuuuagugaggaauccacucucacgaaacuccacacacgaaauguacuggguauccaaugcuaccgggaacauagugucaucagugaacaugauuucgaggauguugaucaauagauucacaaugaaacacaagaaagccaccuacgagccagauguugaccuaggaagcggaacccgcaacauuggaauugaaagugagauaccaaauuuagccauaauaggaaagagaauagagaaaauaaagcaagagcaugaaacaucauggcacuaugaccaagaccacccauacaaaacaugggcuuaccaugguagcuaugaaacaaaacaaacuggaucagcaucaucuauggugaacggaguggucagacugcugacaaaaccuugggacgucgucccaauggugacacagauggcaaugacagacacgacuccauuuggacaacaacgcgucuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauucacaagaaaggugagaagcaaugcagccuugggggccauauucacugaugaaaacaaauggaaaucggcucgugaggcuguugaagacaguagguuuugggagcugguugacagggaaagaaaucuccaucuugaaggaaagugugaaacauguguguacaacaugaugggaaaaagagagaagaagcuaggggaguucggcaaggcaaaagguagcagagccauaugguacauguggcuuggagcacgcuuuuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagagcacaagaaacuagccgaggccguauucaaauuaacguaccaaaacaagguggugcgugugcaaagaccaacaccaagaggcacaguaauggauaucauaucgagaagagaccaaagaggcagcgggcaagucggcaccuauggccucaauacuuucaccaacauggaagcccaacuaauuagacagauggagggagaaggaaucuucaaaagcauucagcaccugacagccacagaagaaaucgcuguacagaacugguuagcaagaguggggcgugaaaggcuaucaagaauggccaucaguggagaugauuguguuguaaaacccuuagaugacagauuugcaagugcuuuaacagcucuaaaugacaugggaaaaguuaggaaagauauacaacaaugggaaccuucaagaggauggaacgacuggacacaagugccuuucuguucacaccacuuucaugaguuagucaugaaagauggucgcgugcuuguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacacuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauauuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaagcagguguccugugguag

SEQ ID NO: 6677 - RNA, 9876 nt, Artificial Sequence
  derived and/or modified CDS sequence (wt) from DENV-2__KC294218__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuugaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggagguauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccgggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaucugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6678 - RNA, 9876 nt, Artificial Sequence
  derived and/or modified CDS sequence (wt) from DENV-2__KC294220__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaugugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6679 - RNA, 9876 nt, Artificial Sequence
  derived and/or modified CDS sequence (wt) from DENV-2__KC294221__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcguggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuuccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgagccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaauuuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaauuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6680 - RNA, 9876 nt, Artificial Sequence
  derived and/or modified CDS sequence (wt) from DENV-2__KC294223__SS-prME
acagcaggcgugauuguuauguugauuccaacagcgauggcguuccauuuaaccacacgcaauggagaaccacacaugaucguugguaggcaggagaaagggaaaagucuucuguucaaaacagaggaugguguuaacauguguacccucauggccauagaccuuggugaguugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcgcucguuccacauguagguaugggacuggagacacgaacugaaacauggaugucaucagaaggggccuggaagcauguucagagaauugaaaccuggaucuugagacauccagguuuuaccauaauggcagcgauccuggcauacaccauaggaacgacacacuuccaaagggccuugauuuucaucuuacugacagcuguugcuccuucaaugacaaugcgcugcauaggaauaucaaauagagacuucguagaagggguuucaggaggaagcuggguugauaucguuuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucacguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucguacagccagaaaauuuggaauacaccaucgugauaacaccucacucaggagaagagcacgcuguagguaaugacacaggaaagcauggaaaggaaaucaaaauaacaccacagaguuccaccacagaagcagaacugacaggcuauggcacugucacgauggagugcuccccgagaacgggccucgacuucaaugagauggugcugcugcagauggaagacaaagcuuggcuggugcacaggcaaugguuccuagaccugccguugccauggcuacccggagcggauacacaaggaucaaauuggauacagaaagagacauuggucacuuucaaaaauccccacgccaagaaacaggaugucguugucuuagggucucaagaaggggccaugcacacggcacucacaggggcuacagaaauccagaugucaucaggaaacuuacuguucacgggacaucucaagugcaggcugagaauggacaaauuacagcucaaaggaaugucauacucuauguguacaggaaaguuuaaaaucgugaaggaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucguaacagaaaaagauagcccagucaacauagaagcagaacccccauucggagacaguuacaucaucguaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaucaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcauugugagcuggaaaaauaaagaacugaaauguggcagcgggaucuucauuacagauaacguacacacauggacagagcaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccucagcccacugagcugaaguacucauggaaaacauggggaaaggcgaaaaugcucucaacagagucucacaaccagaccuuucuuauugauggcccugaaacagcagaaugccccaacacaaacagagcuuggaacucacuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccuauggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaagcucauaacagaauggugcugccgauccugcacacuaccaccucuaagauacagaggugaggauggaugcugguacgggauggaaaucagaccuuugaaagagaaagaagagaacuuggucaacuccuuggucacagccggacaugggcagauugacaacuuuucacuaggagucuugggaauggcacuguuccuggaagaaaugcuuaggacccgaguaggaacgaaacaugcaauacugcuaguugcacuaucuuucgugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauugaugauggccaccauaggaaucgcacuccuuucccaaagcaccuugccagagaccauucuagaacugacugaugcguuagccuugggcaugauggcccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcuccuaacauccucacagcagaaagcggauuggauaccacuggcacugacgauaaaaggucucaacccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccucaccguauguuacgugcucacuggacgaucggccgauuuggaacuggagagagcugccgauguaaaaugggaagaucaggcagaaauaucaggaagcagcccaauucugucaauaacaauaucagaagauggcagcaugucgauaaaaaaugaagaggaagaacaaacacugaccauacucauuagaacgggauuguuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagagaauugaaccaucaugggcagaugucaagaaagaucuaauaucauauggaggaggcuggaagcuagaaggagaauggaaggaaggagaggaaguucaaguccuggcauuggaaccuggaaaaaaucccagagcuguccaaacgaaaccuggaauuuucaaaaccaacaccggaaccauaggcgcuguaucucuggacuuuuccccuggaacgucaggaucuccaauugucgacagaaaaggaaaaguugugggucuuuaugguaaugguguugucacaaggaguggagcauacguaagugccauagcccagacugaaaaaagcauugaagacaauccagagaucgaagaugacauuuuccgaaagaaaagauugaccaucauggaccuccauccaggggcaggaaagacaaaaagauaccuuccagccauaguuagagaagccauaaaacguggcuugagaacacuaauccuggcucccacuagagucguggcagcugaaauggaggaagcucuuagaggacucccaauaagauaccaaaccccagccaucagagccgagcacaccgggcgagagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuuuaugacagccacuccuccgggaagcagagacccauuuccucagagcaaugcaccaaucauggaugaggaaagagaaaucccugagcguucauggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagacccuagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacacuggaaagaagcuaaaaugcuccuagauaacaucaacacacccgaaggaauuauuccuaguauguucgagccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugauccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugagguagguggaaaggcguacacucaugcucucagugaacugccggagacucuggagacacugcuucuacugacacuccuggcagcagucacaggaggaaucuucuuauucuuaaugagcggaaaagguauagggaagaugacucugggaauguguugcauaaucacagcuagcauucuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauuuggaagcauuacaacccaggaaucugagagcaacauccuggacauagaucuacguccugcaucagcauggacgcuguaugccguggcuacaacauuugucacaccaauguugcgacauagcauugaaaauuccucaguaaaugucucccuaacagccauugccaaccaagcuacagugcuaaugggucuugggaaaggauggccauugucaaagauggacaucggaguuccccuccuugccauuggaugcuacucacaagucaaccccauaacccucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaaugugggagagacgcuuggagaaaaauggaaaagccgauuaaaugcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaacauggucacaccggaagggaaggugguggaucuugguugcggcagagggggcuggucauauuauugugggggacuaaagaauguaagagaagucaaaggccuaacaaaaggaggaccaggacacgaagaacccauccccaugucaacauauggguggaaucuagugcgucugcaaaguggggucgacguuuucuucaccccgccagaaaagugugacacauuguugugugacauaggggagucgucaccaaaucccacgauagaagcaggacgaacacucagaguccucaacuuaguggaaaauuggcugaacaauaacacccaauuuugcauaaagguccucaauccauauaugcccucagucauagaaaaaauggaaacacuacaaaggaaauauggaggagccuuagugaggaauccacucucacgaaacuccacgcaugaaauguacuggguaucuaaugcuaccgggaacauagugucaucagugaacaugauuucaaggauguugauuaacagauucacaaugaaacauaagaaagccaccuacgagccagauguugaccuaggaaguggaacccgcaacauuggaauugaaagugagauaccaaaucuagacauagugggaaagagaauagagaaaauaaaacaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucguuccuauggugacacagauggcaaugacagacacgacuccauuuggacaacagcgcguuuucaaagagaaaguggacacgagaacucaagaaccgaaggaaggcacaaagaaacugaugaaaaucacggcagaguggcuuuggaaagaacuaggaaaggaaaagacaccuagaauguguaccagagaagaauucacaagaaaagugagaagcaaugcagccuugggggccguauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaggugggcaagaaggaaggaggagcaauguacgccgaugauacagcaggaugggacacaagaaucacacuagaagacuuaaaaaaugaagaaaugguaacaaaccacaugaaaggagaacauaagaaacuagccgaggccauauucaaauuaacguaccaaaacaagguggugcgugugcaaagaccaacaccaagaggcacaguaauggauaucauaucgagaaaagaccaaagaggcagugggcaagucgguaccuauggccuuaauacuuucaccaauauggaagcccaauuaauuagacagauggaaggagaaggaaucuucaaaagcauucagcaccugaccgccacagaagaaaucgcuguacagaacugguuagcaagaguggggcgugaaaggcuaucaagaauggccaucaguggagaugacuguguuguaaaaccuauagaugacagauuugcaagugcuuuaacagcucuaaaugacaugggaaaaguuaggaaagauauacaacaaugggaaccuucaagaggauggaacgauuggacacaggugccuuucuguucacaccauuuucaugaguuagucaugaaagauggucgcgugcucguagucccaugcagaaaccaagaugaacugauuggcagagcccgaauuucccagggagccggguggucuuugaaggagacggcuuguuuggggaagucuuacgcccaaauguggacccugauguacuuccacagacgugaccucagauuggcggcaaaugccauuugcucggcagucccgucacauuggguuccaacaagucgaacaaccugguccauacacgccaagcaugaauggaugacgacggaagacaugcugguagucuggaacaggguguggauccaagaaaacccauggauggaagacaaaacuccaguggaaucaugggaagaagucccauaccuggggaaaagggaagaccaauggugcggcucauugauugggcuaacaagcagggcuaccugggcaaagaauauccagacagcaauaaaucaagucagaucccuuauaggcaaugagggauacacagacuacaugccauccaugaagagauucagaagggaagaggaagaggcagguguccugugguag

SEQ ID NO: 6681 - RNA, 9876 nt, Artificial Sequence
  derived and/or modified CDS sequence (wt) from DENV-2__FJ906959__SS-prME
acugcaggcaugaucauuaugcugauuccaacagugauggcguuccauuuaaccacacguaacggagaaccacacaugaucgucaguagacaagagaaagggaaaagucuucuguuuaaaacagaggauggugugaacauguguacccucauggccauggaccuuggugaauugugugaagauacaaucacguacaaguguccuuuucucaagcagaaugaaccagaagacauagauuguuggugcaacucuacguccacauggguaacuuaugggacguguaccaccacaggagaacacagaagagaaaaaagaucaguggcacucguuccacaugugggaaugggacuggagacacgaacugaaacauggaugucaucagaaggggccuggaaacaugcccagagaauugaaacuuggaucuugagacauccaggcuuuaccauaauggcagcaauccuggcauacaccauaggaacgacacauuuccaaagagcccugauuuucaucuuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacagaagccaaacaaccugccacucuaaggaaguacuguauagaggcaaagcugaccaacacaacaacagauucucgcugcccaacacaaggagaacccagccuaaaugaagagcaggacaaaagguucgucugcaaacacuccaugguggacagaggauggggaaauggauguggacuauuuggaaaaggaggcauugugaccugugcuauguucacaugcaaaaagaacaugaaaggaaaagucgugcaaccagaaaacuuggaauacaccauugugauaacaccucacucaggggaagagcaugcagucggaaaugacacaggaaaacauggcaaggaaaucaaaauaacaccacagaguuccaucacagaagcagaguugacaggcuauggcacugucacgauggagugcucuccgagaacgggccucgacuucaaugagaugguguugcugcaaauggaaaauaaagcuuggcuggugcacaggcaaugguuccuagaccugccguugccauggcugcccggagcggacacacaaggaucaaauuggauacagaaagagacauuggucacuuucaaaaauccccaugcgaagaaacaggauguuguuguuuugggaucccaagaaggggccaugcacacagcacucacaggggccacagaaauccagaugucaucaggaaacuuacuguucacaggacaucucaagugcaggcugaggauggacaaacuacagcucaaaggaaugucauacucuaugugcacaggaaaguuuaaaguugugaaggaaauagcagaaacacaacauggaacaauaguuaucagaguacaauaugaaggggacgguucuccauguaagaucccuuuugagauaauggauuuggaaaaaagacauguuuuaggucgccugauuacagucaacccaaucguaacagaaaaagauagcccagucaacauagaagcagaaccuccauucggagacagcuacaucaucauaggaguagagccgggacaauugaagcucaacugguuuaagaaaggaaguucuaucggccaaaugauugagacaacaaugaggggagcgaagagaauggccauuuuaggugacacagcuugggauuuuggaucccugggaggaguguuuacaucuauaggaaaggcucuccaccaaguuuucggagcaaucuauggggcugccuucaguggggucucauggauuaugaaaauccucauaggagucauuaucacauggauaggaaugaauucacgcagcaccucacugucugugucacuaguauuggugggagucgugacgcuguauuugggaguuauggugcaggccgauagugguugcguugugagcuggaaaaacaaagaacugaaguguggcagugggauuuucaucacagacaacgugcacacauggacagaacaauacaaguuccaaccagaauccccuucaaaacuagcuucagcuauccagaaagcucaugaagagggcauuuguggaauccgcucaguaacaagacuggaaaaucugauguggaaacaaauaacaccagaauugaaucacauucuaucagaaaaugaggugaaguugacuauuaugacaggagacaucaaaggaaucaugcaggcaggaaaacgaucucugcagccccagcccacugagcugaaguauucauggaaaacauggggcaaagcgaaaaugcucucuacagagucucauaaccagaccuuucucauugauggccccgaaacagcagaaugccccaacacaaacagagcuuggaauucgcuggaaguugaagacuauggcuuuggaguauucaccaccaauauauggcuaaaguugagagaaaagcaggauguauucugcgacucaaaacucaugucagcggccauaaaagacaacagagccguccaugccgauauggguuauuggauagaaagugcacucaaugacacauggaagauagagaaagccucuuucaucgaaguuaaaagcugccacuggccaaagucacacacccucuggaguaauggaguguuagaaagugagaugauaauuccaaagaauuucgcuggaccagugucacaacacaacuacagaccaggcuaccauacacaaacagcaggaccauggcaucuagguaagcuugagauggacuuugauuucugcgaaggaaccacagugguggugacugaggacuguggaaauagaggacccucuuuaagaacaacuacugccucuggaaaacucauaacagaauggugcugccgaucuugcacauuaccaccgcuaagauacagaggugaggacggaugcugguacgggauggaaaucagaccauugaaagagaaagaagagaauuuggucaacuccuuggucacagccggacaugggcagauugacaacuuuucacuaggagucuugggaauggcauuguuccuggaagaaaugcucaggacccgaguaggaacgaaacaugcaauacuacuaguugcaguuucuuuugugacauugaucacagggaacauguccuuuagagaccugggaagagugaugguuauggugggcgcuacuaugacggaugacauagguaugggcgugacuuaucuugcccuacuagcagccuucaaagucagaccaacuuuugcagcuggacuacucuugagaaaguugaccuccaaggaauugaugaugacuaccauaggaaucguacuccucucccagagcaccauaccagagaccauucuugaacugacugaugcguuagccuugggcaugaugguccuuaaaauggugagaaaaauggaaaaguaucaauuggcagugacuaucauggcuaucuugugcgucccaaaugcagugauauuacaaaacgcauggaaagugaguugcacaauauuggcagugguguccguuuccccacuguucuuaacauccucacagcagaaagcggauuggauaccauuagcauugacgaucaagggucucaauccaacagcuauuuuucuaacaacccuuucaagaaccaacaagaaaaggagcuggccacuaaaugaggcuaucauggcagucgggauggugagcauuuuggccaguucacuccuaaagaaugacauucccaugacaggaccauuaguggcuggagggcuccucacugugugcuacgugcucacuggacgaucggccgauuuggaacuggagagagccgccgaugucaaaugggaagaucaggcagagauaucaggaagcaguccaauccugucaauaacaauaucagaagaugguagcaugucgauaaaaaacgaagaggaagaacaaacacugaccauacucauuagaacaggauugcuggugaucucaggacuuuuuccuguaucaauaccaaucacggcagcagcaugguaccugugggaagugaagaaacaacgggcuggaguauugugggaugucccuucacccccacccgugggaaaggcugaacuggaagauggagccuauagaaucaagcaaaaagggauucuuggauauucccagaucggagccggaguuuacaaagaaggaacauuccauacaauguggcaugucacacgcggcgcuguucuaaugcauaaaggaaagaggauugaaccaucaugggcggacguuaagaaagaccuaauaucauauggaggaggcuggaagcuagaaggagaauggaaggaaggagaagaaguccaggucuuggcauuggagccuggaaaaaauccaagagccguccaaacaaaaccuggucuuuucaaaaccaacgccggaaccauaggugccguaucucuggacuuuucuccuggaaccucaggaucuccaaucaucgacaaaaaaggaaaaguugugggucuuuaugguaaugguguuguuacaaggaguggagcauaugugagugcuauagcccagacugaaaaaaguauugaagacaauccagagaucgaagaugacauuuuucgaaagagaaaauugaccaucauggaccuccacccaggagcgggaaagacgaagagauaccuuccggccauagucagagaggcuauaaaacggggccugaggacauuaauccuggcccccacuagagucguggcagcugaaauggaggaagcccuaagaggacuuccaauaagauaccaaaccccagccaucagagcugagcacaccgggcgggagauuguggaccuaaugugucaugccacauucacuaugaggcugcuaucaccaguuagagugccaaauuacaaccugaucaucauggacgaagcccauuucacagacccagcaaguauagcggcuagaggauacaucucaacucgaguagagaugggugaggcagcugggauuuucaugacagccacuccuccgggaagcagagacccauucccucagagcaaugcaccaaucauggaugaagaaagagaaaucccugaacguucguggaguucuggacaugagugggucacggauuuuaaagggaagacuguuugguucguuccaaguauaaaagcaggaaaugauauagcagcuugccugagaaaaaauggaaagaaagugauacaacucaguaggaagaccuuugauucugaguaugucaagacuagaaccaaugauugggacuucguggucacaacugacauuucagaaaugggugccaacuucaaggcugagaggguuauagaccccagacgcugcaugaaaccaguuauacuaacagauggugaagagcgggugauccuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagcuaaaaugcuccuagauaacaucaacacaccugaaggaaucauuccuagcauguucgaaccagagcgugaaaagguggaugccauugauggugaauaccgcuugagaggagaagcaaggaaaaccuuuguggaccuaaugagaagaggagaccuaccagucugguuggccuacagaguggcagcugaaggcaucaacuacgcagacagaaggugguguuuugauggaauuaagaacaaccaaaucuuggaagaaaauguggagguggaaaucuggacaaaagaaggggaaaggaagaaauuaaaacccagaugguuggaugccaggaucuacucugacccacuggcgcuaaaggaauucaaggaguuugcagcuggaagaaagucccugacccugaaccuaaucacagaaauggguaggcuuccaacuuucaugacucagaaggcaagagacgcacuggacaacuuagcagugcugcacacggcugaagcagguggaagggcguacaaucaugcucucagugaacugccggagacccuggagacauugcuuuuacugacacuucuggcuacagucacaggaggaaucuuuuuauucuugaugagcggaagggguauagggaagaugacccugggaaugugcugcauaaucacggcuaguauucuccuaugguacgcacaaauacagccacacuggauagcagcuucaauaauacuggaguuuuuucucauaguuuugcuuauuccagaaccagaaaagcagagaacaccccaagauaaccaauugaccuacguugucauagccauccucacagugguggccgcaaccauggcaaacgagauggguuuccuggaaaaaacgaagaaagaucucggauugggaagcauuacaacccagcaacccgagagcaacauccuggacauagaucuacgucccgcaucagcauggacgcuguaugcuguggccacaacauuugucacaccaauguugagacacagcauugaaaauuccucagugaacgugucccuaacagcuauugccaaccaagccacaguguuaaugggucuugggaaaggauggccauugucaaagauggacaucggaguuccccuucucgccauuggaugcuacucacaagucaaccccauaacucucacagcagcucuuuucuuacugguagcacauuaugccaucauagggccaggacuccaagcaaaagcaaccagagaagcucagaaaagagcagcagcgggcaucaugaaaaacccaacugucgauggaauaacagugauugaccuagauccaauacccuaugauccaaaguuugaaaagcaguugggacaaguaaugcuccuaguccucugcgugacucaaguguugaugaugaggacuacaugggcucugugugaggcuuuaaccuuagcgaccgggccuaucuccacauugugggaaggaaauccagggagguuuuggaacacuaccauugcagugucaauggcuaacauuuuuagagggaguuacuuggccggagcuggacuucucuuuuccaucaugaagaacacaaccaacacgagaaggggaacuggcaacauaggagagacgcuuggagagaaauggaaaagccgauugaacgcauuggggaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucgucgagagaaauauggucacaccagaagggaaaguaguggaccucgguugcggcagaggaggcuggucauacuauugugggggacuaaagaauguaagagaagucaaaggccuaacaaaaggaggaccaggacaugaagaacccauccccaugucaacauauggguggaaucuaguacgucuucaaaguggaguugacguuuucuucacuccgccagaaaagugugacacauuguugugugacauaggggagucgucaccaaaucccacgguagaagcaggacgaacacucagaguccuuaacuuaguggaaaauugguugaacaacaacacccaauuuugcauaaagguucucaacccauacaugcccucagucauagaaaaaauggaagcacuacaaaggaaauauggaggagccuuagugaggaauccacucucacgaaacuccacacaugagauguacuggguauccaaugccuccgggaacauagugucaucagugaacaugauuucaaggauguugaucaacagauucacaaugagacacaagaaagccacuuacgagccagauguagaccucggaagcggaacccgcaacaucggaauugaaagugagauaccaaaccuagacauaaucgggaaaagaauagaaaaaauaaaacaagagcaugaaacaucauggcacuaugaccaagaccacccauacaaaacgugggcuuaccauggcagcuaugaaacaaaacaaacuggaucagcaucauccauggugaacggaguggucagacugcugacaaaaccuugggacgucguccccauggugacacagauggcaaugacagacacgacuccauuuggacaacagcgcguuuuuaaagaaaaaguggacacgagaacccaagaaccgaaagaaggcacaaagaaacuaaugaaaaucacggcagaguggcuuuggaaagaacuagggaagaaaaagacaccuaggaugugcacuagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguauaacaugaugggaaaaagagagaagaagcuaggggaguucggcaaggcaaaaggcagcagagccauaugguacauguggcuuggagcacgcuucuuagaguuugaagcccuaggauucuugaaugaagaucacugguucuccagagagaacuccuugaguggaguggaaggagaagggcugcacaagcuagguuacauuuuaagagacgugagcaagaaagagggaggagcaauguaugccgaugacaccgcaggaugggacacaagaaucacacuagaagaccuaaaaaaugaagaaaugguaacaaaccacauggaaggagaacacaagaaacuagccgaggccauuuucaaauuaacguaccaaaacaagguggugcgugugcaaagaccaacaccaagaggcacaguaauggauaucauaucgagaagagaccaaagagguaguggacaaguugguaccuauggacucaauacuuucaccaauauggaagcccaacuaaucagacagauggagggagaaggagucuucaaaagcauucagcaccugacagucacagaagaaaucgccgugcaaaacugguuagcaagaguagggcgcgaaagguuaucaagaauggccaucaguggagaugauuguguugugaaaccuuuagaugacagguucgcaagcgcuuuaacagcucuaaaugacaugggaaagguuaggaaagacauacaacaaugggaaccuucaagaggauggaacgauuggacacaagugcccuucuguucacaccauuuccaugaguuaaucaugaaagacggccgcguacuuguaguuccaugcagaaaccaagaugaacugauugguagagcccgaauuucccaaggagcuggguggucuuugcgagagacggccuguuuggggaaguccuacgcccaaauguggagcuugauguacuuccacagacgugaccucaggcuggcggcuaaugcuauuugcucggcagucccaucacauuggguuccaacaaguagaacaaccugguccauacacgccaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauugggcuaacaagcagggccaccugggcaaagaacauccaaacagcaauaaaucaaguuagaucccuuauaggcaaugaggaauacacagauuacaugccauccaugaaaagauucagaagagaagaggaagaggcaggaguccugugguag

SEQ ID NO: 6682 - RNA, 9876 nt, Artificial Sequence
  derived and/or modified CDS sequence (wt) from DENV-2__KF360005__SS-prME
accgcaggcgugaucaucaugcggauuccaacagcaauggcguuccauuuaaccacacgcaacggagaaccacacaugaucgucagcaaacaagagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacuccacguccacauggguaacuuaugggacaugcacugccacaggagaacacagaagggaaaaaagaucaguggcacucgucccacaugugggaaugggauuggagacacgaacugaaacguggaugucaucagaaggggccuggaaacacgcccagagaauugaaaccuggaucuugagacauccagguuuuaccauaauggcagcaaucuuggcauacaccauaggaacgacauauuuccaaagaguccugaucuucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguaggcagaggauggggagauggauguggauuauuuggaaagggaggcauugugaccugugcuauguucacaugcaagaaaaacauggaagggaaaauugugcaaccagaaaaccuggaauacaccauugugguaacaccucauucaggggaagagaaugcaguuggaaacgacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguuccuagaccugccguuaccaugguugcccggagcggacauacaaggaucaaauuggauacagaaggagacguuggucacuuucaaaaauccccaugcgaagaaacaggauguuguuguuuuaggaucccaagaaggggcuuugcauaccgcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaauacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacuacaaugagaggagcgaagagaauggccauuuuaggugacacagccugggauuuuggaucccugggaggaguguucacaucuauaggaaaggcccuccaccaagucuuuggagcaaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggagaaacaaagaacugaaauguggcagugggauuuucaucacagacaauguacauacauggacagaacaauacaaauuccaaccagaaucccccucaaagcuggcuucagcuauccagaaagcucaugaagaaggcauuuguggaauccgcucaguaacaagacuggagaaucuaauguggaagcaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucaucgauggccccgaaacagcagaaugucccaacacaaacagagcuuggaacucacuagaaguugaagacuacggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacauacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgagugggaacaaaacaugcaguauuacugguugcaguuucuuucaugacauugaucacagggaacaugucuuuccgagaccuggggagagugauggucauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggccuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuccuaacaacccuuucaagaacuaacaagaaaaggaguuggccacuaaaugaggcuaucauggcagucgggauggugagcauucuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaguaucaggaagcaguccaauucugucaauaacaauaucggaagauggcagcaugucgauaaaaaaugaagaggaagaacaaacacugaccauacucauuagaacaggauugcuggugauaucaggacuuuuccccguaucaauaccaauuacggcagcagcaugguaccugugggaagugaagaaacaacgggcuggaguauugucggcuguuccuucacccccaccugugggaaaggccgaacuggaagauggagcuuacagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggccggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggagcgucaggaucuccaaucgucgacaaaaaaggaaaagucgugggucucuaugguaauggugucgucacaaggaguggaacauaugugagugccauagcccagacugaaaaaagcauugaagacaauccagagauugaagacgauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaagaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacuccuccgggaagcagagacccauuuccucaaagcaaugcaccaaucauggaugaagaaagggaaaucccugaacguucguggaacucuggacaugaguggguuacagauuucaaagggaagacuguuugguuuguuccgaguauaaaagcagguaaugauauagcagcuugccugagaaaaaauggaaagaaagugauacaacucaguaggaagaccuuugauucugaauacaucaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaucaugcucucagugaacugccagagacucuggagacauugcuuuugcugacacuuuuggccacagucacgggcggaaucuuucuauucuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggauugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaaaauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaagaacccaacugcggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaguccagggagauucuggaauacaaccauugcagugucaauggcuaacaucuuuagaggaaguuaccuggcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagaggagcggaauucaggaaguggauagaaccuuggcaaaagaaggcauuaaaagaggagaaacggaccaucaugcugugucgcggggcucagcaaagcugagaugguucgucgagagaaaccugguuacaccagaggggaaaguaguggaccucgguugcgguagagggggcuggucauacuauugugggggucuaaagaauguaagagaagucagaggccuaacaaaaggaggaccaggacacgaagaacccauucccaugucaacauauggguggaaucuugugcgucuccaaaguggaguugaugucuucuuuacuccaccagaaaaaugugacacauuguugugugauauaggggagucgucaccaaaucccacgguugaagcuggacggacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaauaucggaaucgaaagugagacaccaaaccuagacauaauugggaaaagaauagaaaaaauaaaacaagagcaugagacaucauggcacuaugaccaagaccacccauauaaaacuugggccuaccauggcagcuacgaaacaaaacagacuggaucagcaucauccguggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccguaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacgcuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagaaguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacguggccucaggcuggcagcaaacgcuauuugcucggcaguuccaucacauugggucccgacaagucgaacaaccugguccauacacgccagacaugaguggaugacaacagaagacaugcugacagucuggaacaggguguggauucaagaaaacccauggauggaagacaaaacuccaguggaaucaugggaggaaaucccauacuuggggaaaagaggagaccaauggugcggcucauugauaggguuaacaagcagggccaccugggcaaggaacauccaaacagcaauaaaccgaguuagauccuuaauaggcagugagggauacacagacuacaugccauccaugaaaagauucagaagagaagaggacgaggcaggggucuugugguag

SEQ ID NO: 6683 - RNA, 9876 nt, Artificial Sequence
  derived and/or modified CDS sequence (wt) from DENV-2__KJ010185__SS-prME
accgcaggcgugaucaucaugcugauuccaacagcgauggcguuccauuuaaccacacgcaacggagaaccacacaugaucgucagcaaacaggagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacgccacguccacauggguaacuuaugggacaugcacugccacaggagaacacagaagggaaaaaagaucaguggcacuugucccacaugugggaaugggauuggagacacgaacugaaacguggaugucaucagaaggggccuggaaacacgcccagaggauugaaaccuggaucuugagacauccagguuuuaccauaauggcagcaaucuuggcauacaccauaggaacgacauauuuccaaagaguccugauauucaucuuacugacagcugucgcuccuucaaugacaaugcguuguauuggaauaucaaauagagacuucguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacuguauagaggcaaagcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaagaaaaacauggaagggaaaauugugcaaccagaaaaccuggaauacaccauugugguaacaccucauucaggggaagagaaugcaguuggaaacgacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguuccuagaccugccguuaccaugguugcccggagcggacauacaaggaucaaauuggauacagaaggagacguuggucaccuucaaaaauccccaugcgaagaaacaggauguuguuguuuuaggaucccaagaaggggcuaugcauacagcacuuacaggggccacggaaauccagaugucaucaggaaacccacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaauacaauaugaaggggauggcucuccauguaaaaucccuuuugagauaauggauuuggaaaaaagacaugucuuaggucgccugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgagacaacaaugagaggagcgaagagaauggccauuuuaggugacacagccugggauuuuggaucccugggaggaguguucacaucuauaggaaaggcccuccaccaaguuuuuggagcaaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacaaagaacugaaauguggcagugggauuuucuucacagacaauguacacacauggacagaacaauacaaauuccaaccagaaucccccucaaagcuggcuucagcuauccagaaagcucaugaagaaggcauuuguggaauccgcucaauaacaagacuggauaaucuaauguggaaacaaauaacaccagaacugaaucacauucuaucagaaaaugagguaaaguugucuaucaugacaggggacaucaaaggaaucaugcaggcaggaaaacgaucccugcggccucagcccacugagcugaaauauucauggaaaacguggggcaaagcgaaaaugcucuccacagagccucauaaccagaccuuucucauugauggccccgaaacagcacaaugucccaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuuuaucgaaguuaaaaguugccacuggccaaaaucacacacucucuggaguaacggagugcuagaaagugagaugauaauuccaaagaauuuugcuggaccaguaucgcaacacaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacauggacagauugacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacuugaacugacugaugcguuggcuuugggcaugaugauucucaagauagugagaaacauggaaaaguaucaauuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagcuauuuuccuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaaguaguccaauucugucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggauguuccuucacccccaccugugggaaaggccgaacuggaagauggagcuuacagaaucaagcagaaagggauucuuggauacucccagaucggagcuggaguuuacaaagaaggaacauuccacacaauguggcacgucacacguggugcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacaccggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagacgauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagagucguggcagcugaaauggaggaagcucuuagaggacuuccaauaagauaccaaaccccagccaucagagcugagcacacugggcgagaaaucguggauuuaaugugucaugccacauuuaccaugaggcuguuaucaccaguuagagugccaaauuacaacuugaucauuauggaugaagcccauuucacagacccagcaagcauagcagcuagaggauacauuucaacucgaguagaaaugggugaagcagcugggauuuucaugacagccacucccccgggaagcagagacccauuuccucaaagcaaugcaccaaucauggaugaagagagggaaaucccugaacguucguggaacucuggacaugaguggguuacagauuucaaagggaagacuguuugguuuguuccgagcauaaaagcagguaaugauauagcagcuugccugagaaaaaauggaaagaaagugauacaacucaguaggaagaccuuugauucugaauacauuaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguggcagccgaaggcauuaacuaugcagacagaaggugguguuuugauggaaucaagaacaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcucccaacuuuuaugacucagaaagcaaggaacgcacuggacaacuuagcaguccugcauacggcugaagcaggcggaagggcguacaaccaugcucucagugaacugccagagacucuggagacauugcuuuugcugacacuuuuggccacagucacgggcggaaucuuuuuauuuuugaugaguggcaaagguauagggaaaaugacccugggaaugugcugcauaaucacggccaguauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggacugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugcuaaucaagccacagugcuaaugggucuugggaaaggauggccauugucgaagauggacauuggaguuccccuucucgccaucgggugcuauucacaagucaaccccauaacccucacagcagcccuucuuuuauugguagcacauuacgcuaucauagggccaggacuccaagcgaaagcauccagagaagcgcagaaaagagcagcagcaggcaucaugaaaaacccaacuguggauggaauaacagugauugaccuagauccaauacccuaugacccaaaauuugagaagcagcugggacaaguaaugcuccuaauccucugcgugacucaaguacugaugaugaggacuacaugggcuuugugcgaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgagugucauuguuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccuaacuggagcugauguuuucuuuacuccaccagaaaaaugugacacauuguugugugauauaggggagucgucaccaaaucccacgguugaagcuggacgaacacucagaguccuaaacuugguagaaaauuggcugaacaacaacacccaauuuuguauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgacccagauguugaccucggaagcggaacccgcaacaucggaaucgaaagugaaacaccaaaccuagacauaauugggaaaagaauagaaaaaauaaaacaagagcaugagacaucacggcacuaugaccaagaccacccauauaaaacuugggccuaccauggcagcuacgaaacaaaacagacuggaucagcaucauccacggugaauggaguaguuagacugcugacaaaaccuugggacgucaucccuauggugacacagauggcaaugacagacacgaccccauuuggacaacagcguguuuucaaagagaaaguggacacgagaacccaagaaccgaaagaaggcacgaagaaacuaaugaaaaucacggccgaauggcucuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaagugagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguguacaaguugguaccuaugggcucggcaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauuguguugugaaacccuuagaugacagguuugcaagcgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaaugcuauuugcucggcaguuccaucacauuggguuccgacaagucgaacaaccugguccauacacgccggacaugaauggaugacaacagaagacaugcugacagucuggaacaggguguggauucaagaaaacccauggauggaagacaaaacuccaguggaaucaugggaggaaaucccauacuuggggaaaagagaagaccaauggugcggcucauugauaggguuaacaagcagggccaccugggcaaggaacauccaaacagcaauaaaccaaguuagauccuuaauaggcagugaggaauacacagacuacaugccauccaugaaaagauucggaagagaagaggaagaggcaggggucuugugguag

SEQ ID NO: 6684 - RNA, 9876 nt, Artificial Sequence
  derived and/or modified CDS sequence (wt) from DENV-2__KJ010186__SS-prME
accgcaggcgugaucaucaugcugauuccaacagcgauggcguuccauuuaaccacacgcaacggagaaccacacaugaucgucagcaaacaggagaaagggaaaagucucuuguuuaaaacagaggauggugugaacaugugcacccucauggccauggaccuuggugaacugugugaagacacaaucacuuauaacuguccucuucucaggcagaaugaaccagaagauauagauuguugguguaacgccaccuccacauggguaacuuaugggacaugcacugccacaggagaacacagaagggaaaaaagaucaguggcacuugucccacaugugggaaugggauuggagacacgaacugaaacguggaugucaucagaaggggccuggaaacacgcccagaggauugaaaccuggaucuugagacauccagguuucaccauaauggcagcaaucuuggcauacaccauaggaacgacauauuuccaaagaguccugauauucaucuuacugacagcugucgcuccuucaaugacaaugcguuguauuggaauaucaaauagagacuuuguggaagggguuucaggaggaagcuggguugacauagucuuagaacauggaagcugugugacaacgauggcaaaaaacaaaccaacauuggacuuugaacugauaaaaacagaagccaagcaaccugccacucuaaggaaguacugcauagaggcaaggcugaccaacacaacaacagcaucucgaugcccaacacaaggggaacccagccuaaaugaagaacaggacaaaagguuugucugcaaacauuccaugguagacagaggauggggaaauggauguggauuauuuggaaagggaggcauugugaccugugcuauguucacaugcaaaaaaaacauggaagggaaaauugugcaaccagaaaaccuggaauacaccauugugguaacaccucauucaggggaagagaaugcaguuggaaaugacacaggaaaacauggcaaggaaaucaaagugacaccacagaguuccauuacagaagcagaacugacaggcuacggcacugucacgauggagugcucuccaagaacgggccucgacuucaaugagaugguguugcugcaaauggaaaacaaggcuuggcuggugcacaggcaaugguucuuagaccugccguuaccauggcugcccggagcggacauacaaggaucaaauuggauacagaaggagacguuggucaccuucaaaaaaccccaugcgaagaaacaggauguuguuguuuuaggaucccaagaaggggcuaugcauacagcacuuacaggggccacggaaauccagaugucaucaggaaaccuacuguucacaggacaucucaagugcaggcugagaauggauaaauuacagcucaaaggaaugucauacucuauguguacaggaaaguuuaaaguuguaaaggaaauagcagaaacacaacauggaacaauaguugucagaguacaauaugaaggggauggcucuccauguaaaaucccuuuugagauaauggauuuggaaaaaagacaugucuuaggucgucugauuacagucaacccaaucgucacagaaaaagacaguccagucaacauagaagcagaacccccauucggagacagcuacaucauuauaggaguagaaccgggacaacugaagcucagcugguuuaagaaaggaagcucaaucggccaaauguucgaaacaacaaugagaggagcgaagagaauggccauuuuaggugacacagccugggauuuuggaucccugggaggaguguucacaucuauaggaaaggcccuccaccaaguuuuuggagcuaucuauggggcugccuucagugggguuucauggacuaugaaaauccucauaggaguugucaucacauggauaggaaugaauucacguagcaccucacugucugugucacuaguauuagugggagucgugacauuguacuugggaguuauggugcaggcugauagugguuguguugugaguuggaaaaacacagcacugaaauguggcagugggauuuucaucacagacaauguacacacauggacagaacaauacaaauuccaaccagaaucccccucaaagcuggcuucagcuauccagaaagcucaugaagaaggcauuuguggaauccgcucaguaacaagauuggagaaucuaauguggaaacaaauaacaccagaacugaaucacauccuaucagaaaaugagguaaaguugucuaucaugacaggggacaucaaaggaauauugcaggcaggaaaacgaucccugcggccucagcccacugagcugaaauauucauggaaaacguggggcaaagcgaaaaugcucuccacagagucucauaaccagaccuuucucauugauggccccgaaacagcagaauguccuaacacaaacagagcuuggaacucacuagaaguugaagacuauggcuuugggguauucaccaccaacauauggcugaaguugaaagaaaggcaggauguguuuugugacucaaaacucaugucagcggccauaaaagacaacagagccguccaugccgauauggguuauuggauagaaagcgcacuuaaugacacauggaagauagaaaaagcuucuuucaucgaaguuaaaaguugccacuggccaaaaucacacacucucuggaguaacggagugcuagaaagugagaugauaauuccaaagaauuuugcuggaccaguaucgcaacauaauuacagaccaggcuaucacacacaaacggcaggaccuuggcaucuaggcaagcuugagauggacuuugauuuuugcgaaggaaccacagugguggugacugaggacugcggaaauagaggacccucucuaagaacaacuacugcuucuggaaaacucauaacagaauggugcugccgauccugcacauuaccaccacuaagauacagaggcgaggauggaugcugguacggaauggaaaucagaccauugaaagagaaagaagagaacuuggucaauucuuuggucacagccggacaugggcagauugacaacuucucacuaggagucuugggaauggcacuguuccuggaagaaaugcucaggacccgaguaggaacaaaacaugcaguauuacugguugcaguuucuuucaugacauugaucacagggaacaugucuuuccgagaccuggggagagugaugguuauggugggggccgcuaugacggaugacauagguaugggcgugacuuaucuugccuuacuagcagccuucaaaguuagaccaacuuuugcagcuggacugcuuuugagaaagcugaccuccaaggaauugaugaugaccaccauaggaaucguacuccucucccagagcaccacaccagagacuauacucgaacugacugaugcguuggcuuugggcaugaugauucucaagauagugagaaacauggaaaaguaucaacuggcagugacuaucauggcuaucuuauguguuccaaaugcagugauauuacaaaaugcauggaaagugagcugcacaauacuggcagcgguguccguauccccacugcucuuaacaucuucgcagcagaaagcggauuggauaccauuggcauugacgaucaaaggucucaauccaacagccauuuuucuaacaacccuuucaagaacuaacaagaaaaggaguuggccacuaaaugaggcuaucauggcagucgggauggugagcauuuuagcuaguucucucuugaagaaugacauucccaugacaggaccauuaguggcuggagggcuucucacuguguguuacgugcucacuggaagaucggccgaccuggaacuagagagagccgccgacguuagaugggaagaucaggcagaaauaucaggaaguaguccaauucuaucaauaacaauaucggaagauggcagcaugucgauaaaaaaugaagaggaagaacaaacacugaccauacucauuagaacaggauugcuggugauaucaggacuuuuccccguaucaauaccaaucacggcagcagcaugguaccugugggaagugaagaaacaacgggcuggaguauugugggauguucguucauacccaccugugggaaaggccgaacuggaagauggagccuacagaaucaagcagaaagggauucuuggauacucccagaucggagcuggaguuuacaaagaaggaacauuccacacaauguggcacgucacacguggcgcuguucuaaugcacaaagggaagaggauugaaccaucaugggcggaugucaggaaagaccuaauaucguauggaggaggcuggaagcuagaaggagaauggaaggaaggagaagaaguccaggucuuggcauuagagccuggaaagaauccaagagccguccaaacaaaacccggucuuuuuaagacuaacacuggaaccauaggcgcugugucccuagacuuuucuccuggaacgucaggaucuccaaucgucgacaaaaaaggaaaagucgugggucucuaugguaauggugucgucacaaggaguggaacauaugugagugccauagcccagacugaaaaaagcauugaagacaauccagagauugaagaugauaucuuucgaaaaaaaagauugaccauuauggaccuccacccaggagcgggaaagacgaaaagauaccuuccagcaauaguuagagaggccauaaaacgaggcuuaagaacauuaauccuggcccccacuagaguuguggcagcugaaauggaagaagcucuuagaggacuuccaauaagauaccaaaccccagccaucagagcugagcacacugggcgagaaaucguggauuuaaugugccaugccacauuuaccaugaggcuguuaucaccaguuagagugccaaauuacaacuugaucauuauggaugaagcccauuucacagacccagcaagcauagcagcuagaggauacauuucaacucgaguagagaugggugaagcagcugggauuuucaugacagccacucccccgggaagcagagacccauuuccucaaagcaaugcaccaaucauggaugaagagagggaaaucccugaacguucguggaacucuggacaugaguggguuacagauuucaaagggaagacuguuugguuuguuccgagcauaaaagcagguaaugauauagcagcuugccugagaaaaaauggaaagaaagugauacaacucaguaggaagaccuuugauucugaauacauuaagaccaggaccaaugauugggacuuuguggucacgacugacauuucagaaaugggugcuaacuucaaggcugaaaggguuauagaccccaggcgcugcaugaaaccagucauacuaacggacggugaagagcgggugauccuggcaggacccaugccagugacccacucuagugcagcacaaagaagagggagaauaggaagaaauccaaaaaaugaaaaugaccaguacauauacaugggggaaccucuggaaaaugaugaagacugcgcacacuggaaagaagccaagaugcuuuuagacaacaucaacacgccugaaggaaucauucccagcauguucgaaccagagcgugaaaagguggaugcuauugauggugaauaccgcuuaagaggagaagcgaggaaaaccuuuguggaucuaaugagaagaggagaccuaccagucuggcuggccuacagaguagcagccgaaggcauuaacuaugcagacagaaggugguguuuugauggaaucaagaauaaccaaaucuuagaagaaaauguggaaguggaaaucuggacaaaagaaggggaaaggaagaaacugaaacccagauggcuggaugcucggaucuacucugacccacuggcgcucaaagaauucaaagaguuugcagcuggaagaaaaucccugacccugaauuuaaucacagaaauggguaggcuuccaacuuuuaugacucagaaagcaaggaacgcacuggacaacuuagcaguccugcauacggcugaagcaggcggaagggcguacaaccaugcucucagugaacugccagagacucuggagacauugcuuuugcugacacuuuuggccacagucacgggcggaaucuuuuuauuuuugaugaguggcaaagguauagggaaaaugacccugggaaugugcugcauaaucacggccagcauucuccuaugguacgcacaaauacagccacacuggauagcagcuucaauaauacuggaguuuuuucucauagucuugcucauuccagagccagaaaagcaaagaacaccccaagauaaccaauugacuuacguugucauagccauccucacagugguggccgcaaccauggcaaaugagaugggguuccuggaaaaaacgaagaaagauuucggacugggaagcauugcaacccagcaacccgagagcaacauccuggacauagaucuacguccugcaucagcauggacccuguaugcaguggccacaacauuuaucacaccaauguugagacauagcauugaaaauuccucagugaacgugucucuaacagccauugccaaccaagccacagugcuaaugggucuugggaaaggauggccauugucgaagauggacauuggaguuccccuucucgccaucgggugcuauucacaagucaaccccauaacccucacagcagcccuucuuuuauugguagcacauuacgcuaucauagggccaggacuccaagcgaaagcaaccagagaagcgcagaaaagagcagcagcaggcaucaugaaaaacccaacuguggauggaauaacagugauugaccuagauccaauacccuaugacccaaaauuugagaagcagcugggacaaguaaugcuccuaguccucugcgugacucaaguacugaugaugaggacuacaugggcuuugugugaggcucuaaccuuagcgaccgggcccaucuccacauugugggaaggaaauccagggagauucuggaauacaaccauugcagugucaauggcuaacauuuuuagaggaaguuaccuagcuggagcuggacuucucuuuuccaucaugaagaacacaaccaacacaagaaggggaacuggcaacacaggagagacgcuuggagagaaauggaaaaaccgauugaauucauuggggaagagugaauuccagauuuacaagagaagcggaauucaggaaguggauagaaccuuggcaaaagaaggcauuaaaagaggagaaacggaccaucaugcugugucgcgaggcucagcaaagcugagaugguucgucgagagaaaccugguuacaccagaggggaaaguaguggaccucgguugcgguagagggggcuggucauacuauugugggggucuaaagaauguaagagaagucaaaggccuaacaaaaggaggaccaggacacgaagaacccauucccaugucaacauauggguggaaucuugugcgucuccaaaguggaguugauguuuucuuuacuccaccagaaaaaugugacacauuguugugugauauaggggagucgucaccaaaucccacgguugaagcuggacgaacacucagaguccuaaacuugguagaaaauuggcugaacaacaacacccaauuuugcauaaagguucuuaacccauacaugcccucagucauagaaaaaauggaaacgcugcaaaggaaauacggaggagcuuuggugaggaauccccucucaagaaauuccacacaugagauguauuggguauccaaugcuuccgggaacauagugucaucagugaacaugauuucaaggauguugaucaauagauuuacaaugagacauaagaaggccacauacgagccagauguugaccucggaagcggaacccgcaacaucggaaucgaaagugagacaccaaaccuagacauaauugggaaaagaauagaaaaaauaaaacaagagcaugagacaucauggcacuaugaccaagaccacccauauaaaacgugggccuaccauggcagcuacgaaacaaaacagacuggaucagcaucauccauggugaauggaguaguuagacugcugacgaaaccuugggacgucauuccuauggugacacagauggcaaugacagacacgaccccauuuggacaacagcguguuuucaaagagaaaguggacacgagaacccaagaaccgaaagaaggcacgaagaaacuaaugaaaaucacggccgaauggcuuuggaaagaacuagggaagaaaaagacaccuagaaugugcacuagagaagaauucgcaagaaaggugagaagcaaugcagcccuaggugccauauucacugaugagaacaaguggaagucggcacgugaggcuguugaagacaguagauuuugggaacuaguugacaaggaaaggaaucuccaucuugaaggaaagugugagacauguguguacaacaugaugggaaagagagagaagaagauaggggaauucggcaaagcaaaaggcagcagagccauaugguacauguggcuuggagcacgcuucuuagaguuugaagcccuaggauuucugaaugaagaucacugguuuuccagagagaacucucugagcggaguggaaggagaagggcugcacaagcuggguuacauucuaagagaaguaagcaagaaagaaggaggagcaauguacgccgacgacacagcaggaugggauacaagaaucacacuagaggaccuaaaaaaugaagagaugguaacaaaccauauggaaggagaacacaagaaacuugcugaggccaucuucaaauuaacguaccaaaacaagguggugcgugugcaaagacccacaccaagaggcacaguaauggauauuauaucgagaagagaccaaagagguaguggacaaguuggcaccuauggccucaacaccuuuaccaauaugggagcccaacuaaucagacagauggagggagagggagucuuuaaaggcauccagcaucugacagccacagaagaaguugcagugcaagacugguuagcaagaguggggcgugagagguuaucaagaauggccaucaguggagaugauugcguugugaaacccuuagaugacagguuugcaaacgcuuuaacagcucuaaaugacaugggaaagguuaggaaagacauacaacaaugggaaccuucaagaggauggaacgacuggacacaagugccuuucuguucacaccauuuccaugaguuaaucaugaaagacggucgugugcucguaguuccauguagaaaccaagaugaacugauugguagagcucgaauuucccagggagccggguggucuuugcgggagacggccugucuggggaagucuuacgcccaaauguggagccugauguacuuccacagacgugaccucaggcuggcagcaaacgcuauuugcucggcaguuccaucacacuggguuccgacaagucgaacaaccugguccauacacgccagacaugaauggaugacaacagaagacaugcugacagucuggaacaggguguggauucaagaaaacccauggauggaagacaaaacuccaguggaaucaugggaggaaaucccauacuuggggaaaagagaagaccaaugguguggcucauugauaggguuaacaagcagggccaccugggcaaggaacauccaaacagcaauaaaccaaguuagauccuuaauaggcagugaggaauacacagacuacaugccauccaugaaaagauucagaagagaagaggaagaggcaggggucuugugguag

SEQ ID NO: 6685 - RNA, 9876 nt, Artificial Sequence
  derived and/or modified CDS sequence (wt) from DENV-2__KF955364__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagacacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguauuguauagaagcaaagcugaccaacacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauauaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaauccaaucguaacagaaaaagauagcccagucaacauagaagcagaaccuccauucggagacagcuacaucaucauaggaguagagccgggacaacugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuugcggaauccgcucaguaacaagauuggagaaucugauguggaaacaaauaacaccagaauugaaucacauucuuucagagaaugggguaaaguugaccauuaugacaggagacauuaaaggaaucaugcaggcaggaaaacgauccuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuaugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaagaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaauaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaagguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaacauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagccgccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaagaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugagccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccgaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaacuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaaccccauaacucucacagcagcucuucuucuacugguagcacauuaugccauuauagggccgggacuucaagcgaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaagguaguggaccucgguugcggcagagggggcuggucauacuauugugggggacuaaagaauguaagagaagucaaaggccugacaaaaggaggaccaggacaugaagaacccauccccaugucaacauauggguggaaccuagugcgucugcaaaguggaguugacguuuucuucaccccgccagaaaagugugacacauuguugugugauauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuacagggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6686 - RNA, 9876 nt, Artificial Sequence
  derived and/or modified CDS sequence (wt) from DENV-2__KF955372__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucauuugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagaguacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugaaauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggauguuguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacguagaagcagaaccuccauucggagacagcuacaucaucauaggaguagagccgggacaauugaaacucaauugguucaagaagggaaguucuauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacuaucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuugggguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaacuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuaugguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguacagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagccgcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacacuggaaagaagcuaaaaugcucuuagauaacaucaacacaccugaaggaaucauuccuaguauguucgaaccagagcgugaaaagguugaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggccaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauucugcauaaagguucucaacccauauaugcccucagucauagaaaaaauggaaacacuacaaaggaaauauggaggagccuuggugaggaauccacucucacgaaacuccacacaugagauguacuggguauccaaugcuacugggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggagucgucagacugcugacaaaaccuugggacgucgucccuauggugacacagauggcaaugacagacacgacuccauuuggacaacaacgcguuuucaaagagaaaguagacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcagagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6687 - RNA, 9876 nt, Artificial Sequence
  derived and/or modified CDS sequence (wt) from DENV-2__KF955373__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuuuggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccauuaucgauaccaauuacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacauuggaguuccccuccuugccauuggaugcuauucacaagucaacccuauaacucucacagcagcucuucuucuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauuguggaggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6688 - RNA, 9876 nt, Artificial Sequence
  derived and/or modified CDS sequence (wt) from DENV-2__GQ868600__SS-prME
acugcaggcaugaucaucaugcugauuccaacagugauggcguuucaucugaccacacgcaacggagaaccacacaugaucgucaguagacaagaaaaagggaaaagccuucuguuuaagacaaaggacggcacgaacauguguacccucauggccauggaccuuggugaguugugugaagacacaaucacguauaaaugucccuuucucaagcagaacgaaccagaagacauagauuguuggugcaacuccacguccacauggguaacuuaugggacauguaccaccacaggagagcacagaagagaaaaaagaucaguggcgcuuguuccacacgugggaaugggauuggagacacgaacugaaacauggaugucaucagaaggggccuggaaacaugcccagagaauugaaacuuggauucugagacauccaggcuuuaccauaauggccgcaauccuggcauacaccauaggaacgacgcauuuccaaagaguccugauauucauccuacugacagccaucgcuccuucaaugacaaugcgcugcauaggaauaucaaauagggacuuuguggaaggagugucaggagggaguuggguugacauaguuuuagaacauggaaguugugugacgacgauggcaaaaaauaaaccaacacuggacuuugaacugauaaaaacagaagccaaacaacccgccaccuuaaggaaguacuguauagaggcuaaacugaccaacacgacaacagacucgcgcugcccaacacaaggggaacccacccugaaugaagagcaggacaaaagguuugucugcaaacauuccaugguagacagaggauggggaaauggauguggauuauuuggaaaaggaggcaucgugaccugugccauguucacaugcaaaaagaacauggaaggaaaaauugugcagccagaaaaccuggaauacacugucgugauaacaccucauucaggggaagaacaugcagucggaaaugacacaggaaaacaugguaaagaagucaagauaacaccacagagcuccaucacagaggcggaacugacaggcuauggcacuguuacgauggagugcucuccaagaacgggccucgacuucaaugagaugguguugcugcaaauggaagacaaagcuuggcuggugcacagacaaugguuccuagaccuaccguugccauggcugcccggagcagacacacaaggaucaaauuggauacagaaagagacacuggucaccuucaaaaauccccaugcgaaaaaacaggauguuguugucuuaggaucccaagagggggccaugcauacagcacucacaggggcuacggaaauccagaugucaucaggaaaccugcuguucacaggacaucuuaagugcaggcugagaauggacaaauuacaacuuaaagggaugucauacuccaugugcacaggaaaguuuaaaauugugaaggaaauagcagaaacacaacauggaacaauagucauuagaguacaauaugaaggagacggcucuccaugcaagaucccuuuugagauaauggaucuggaaaaaagacauguuuugggccgccugaucacagucaacccaauuguaacagaaaaggacaguccagucaacauagaagcagaaccuccauucggagacagcuacaucaucauaggaguggaaccaggacaauugaagcuggacugguucaagaaaggaaguuccaucggccaaauguuugagacaacaaugaggggagcgaaaagaauggccauuuugggcgacacagccugggauuuuggaucucugggaggaguguucacaucaauaggaaaggcucuccaccagguuuuuggagcaaucuacggggcugcuuucaguggggucucauggacuaugaagauccucauaggaguuaucaucacauggauaggaaugaacucacguagcacaucacugucugugucacugguauuagugggaaucgugacacuguacuugggaguuauggugcaggccgauagugguugcguugugagcuggaagaacaaagaacuaaaauguggcaguggaauauucgucacagauaacgugcauacauggacagaacaauacaaguuccaaccagaauccccuucaaaacuggcuucagccauccagaaagcucaugaagagggcaucuguggaauccgcucaguaacaagacuggaaaaucuuauguggaaacaaauaacaucagaauugaaucauauucuaucagaaaaugaagugaaacugaccaucaugacaggagacaucaaaggaaucaugcagguaggaaaacgaucucugcggccucaacccacugaguugagguauucauggaaaacaugggguaaagcgaaaaugcucuccacagaacuccauaaucagaccuuccucauugauggucccgaaacagcagaaugccccaacacaaacagagcuuggaauucacuagaaguugaggacuacggcuuuggaguauucacuaccaauauauggcuaagauugagagaaaagcaggaugcauuuugugacucaaaacucaugucagcggccauaaaggacaacagagccguccaugcugauauggguuauuggauagaaagcgcacucaaugauacauggaagauagagaaagcuucuuucauugaagucaaaaguugccacuggccaaagucacacacucuauggaguaauggagugcuagaaagcgagaugguaauuccaaagaauuucgcuggaccagugucacaacauaauaacagaccaggcuaucacacacaaacagcaggaccuuggcaucuaggcaagcuugagauggacuuugauuucugcgaagggacuacaguggugguaaccgaggacuguggaaacagagggcccucuuuaagaacaaccacugccucaggaaaacucauaacggaaugguguugucgaucuugcacacuaccaccacuaagauacagaggugaggauggaugcugguacgggauggaaaucagaccauugaaagagaaagaagaaaaucuggucaguucucuggucacagccggacaugggcagauugauaauuucucauuaggaaucuugggaauggcacuguuccuugaagaaaugcucaggacucgaguaggaacgaaacaugcaauauuacuagucgcaguuucuuucguaacguuaaucacagggaacaugucuuuuagagaccugggaagagugaugguuauggugggugccaccaugacagaugacauaggcaugggugugacuuaucuugcucuacuagcagcuuucaaagucagaccaaccuuugcagcuggacugcucuugagaaaacugaccuccaaggaauuaaugaugaccaccauaggaaucguucuucucucccagaguagcauaccagagaccauucuugaacugaccgaugcguuagcuuuaggcaugaugguccucaagauggugagaaacauggaaaaauaucagcuggcagugacuaucauggcuauuuugugcgucccaaaugcugugauauuacagaacgcauggaaagugaguugcacaauauuggcaguggugucuguuuccccccugcucuuaacauccucacaacagaaagcggacuggauaccauuagcguugacgaucaaaggccucaauccaacagccauuuuucuaacaacccucucaagaaccagcaagaaaaggagcuggccuuuaaaugaggccaucauggcgguugggauggugaguaucuuggccagcucucucuuaaagaaugacauccccaugacaggaccauuaguggcuggagggcuucuuacugugugcuacguacuaacugggcggucagccgaucuggaacuagagagagcuaccgaugucaaaugggaugaccaggcagagauaucagguagcaguccaauucugucaauaacaauaucagaagauggcagcaugucaauaaagaaugaagaggaagagcaaacauugacuauacucauuagaacaggauugcuugugaucucaggacucuuuccgguaucaauaccaauuacagcagcagcaugguaccugugggaaguaaagaaacaacgggcuggaguguugugggauguccccucaccaccacccgugggaaaggcugaauuggaagauggagccuacagaaucaagcaaaaaggaauccuuggauauucccagaucggagcuggaguuuacaaagaaggaacauuucacacaauguggcacgucacacguggcgcuguccuaaugcauaaggggaagaggauugaaccaucaugggcggacgucaagaaagacuuaauaucauauggaggagguuggaagcuagaaggagaauggaaagaaggagaagaaguccaggucuuggcauuggagccugggaaaaauccaagagccguccaaacaaaaccuggccuuuuuagaaccaauacuggaaccauaggugccguaucucuggacuuuuccccugggacgucaggaucuccaaucgucgacaaaaaaggaaaaguuguaggucucuauggcaauggugucguuacaaggaguggagcauaugugagugccauagcucagacugaaaaaagcauugaagacaauccagagauugaagaugacaucuuucgaaagagaagauugacuaucauggaucuccacccaggagcaggaaagacaaagagauaccucccggccauagucagagaggccauaaaaagaggcuugagaacacuaauccuagcccccacuagagucguggcagcugaaauggaggaagcccuuagaggacuuccaauaagauaccaaacuccagcuaucagggcugagcacaccgggcgggagauuguggacuuaaugugucaugccacauuuaccaugaggcugcuaucaccaaucagggugccaaauuacaaccugaucaucauggacgaagcccauuuuacagauccagcaagcauagcagcuaggggauacaucucaacucgaguggagaugggugaggcagcuggaauuuuuaugacagccacuccuccggguagcagagauccauuuccucagaguaaugcaccaauuauggacgaagaaagagaaaucccggaacguucauggaacuccgggcacgagugggucacggauuuuaaaggaaagacugucugguuuguuccaagcauaaaaaccggaaaugacauagcagccugccugagaaagaauggaaagagggugauacaacucaguaggaagaccuuugauucugaauaugucaagacuagaaccaaugacugggauuucgugguuacaacugacaucucggaaaugggugccaacuuuaaagcugagaggguuauagaccccagacgcugcaugaaaccaguuauacugacagacggcgaagagcgggugauucuggcaggacccaugccagugacccacucuagugcagcacaaagaagagggagaauaggaaggaauccaaggaaugaaaaugaucaauauauauauaugggggaaccccuggaaaaugaugaagacugugcgcacuggaaggaagcuaagaugcuccuagauaacaucaacacaccugaaggaaucauucccagcauguucgagccagagcgugaaaagguggaugccauugacggugaauaucgcuugagaggagaagcacggaaaacuuuuguggaccuaaugagaagaggagaccuaccagucugguuggcuuauaaaguggcugcugaagguaucaacuacgcagacagaagaugguguuuugacggaaccagaaacaaucaaaucuuggaagaaaauguggaaguggaaaucuggacaaaggaaggggaaaggaaaaaauugaaaccuagaugguuagaugcuaggaucuacuccgacccacuggcgcuaaaagaauucaaggaauucgcagccggaagaaagucccuaacccugaaccuaaucacagagaugggcagacucccaacuuuuaugacucagaaggccagagaugcacuagacaacuuggcggugcugcacacggcugaagcggguggaaaggcauacaaucaugcucucagugaacuaccggagacccuggagacauugcuuuugcugacacuguuggccacagucacgggaggaaucuuucuauuccugaugagcggaagggguauagggaagaugacccugggaaugugcugcauaaucacggccagcauccucuuaugguaugcacaaauacaaccacauuggauagcagcuucaauaauauuggaguucuuucucauagucuugcucauuccagaaccagaaaagcagaggacaccccaggauaaccaauugacuuaugucaucauagccauccucacagugguggccgcaaccauggcaaacgaaauggguuuucuggaaaaaacaaagaaagaccucggacugggaaacauugcaacucagcaaccugagagcaacauucuggacauagaucuacguccugcaucagcauggacguuguaugccguggcuacaacauuuaucacaccaauguugagacauagcauugaaaauuccucaguaaaugugucccuaacagccauagcuaaccaagccacagugcuaaugggucucgggaaaggauggccauugucaaagauggacauuggaguuccccuccuugcuauuggguguuacucacaagucaacccuauaacccucacagcggcucuucuuuuauugguagcacauuaugccaucauaggaccgggacuucaagccaaagcaaccagagaagcucagaaaagagcagcagcgggcaucaugaaaaacccaacuguggauggaauaacagugauagaucuagauccaauacccuaugauccaaaguuugaaaagcaguugggacaaguaaugcuccuaguccucugugugacccaagugcugaugaugaggacuacgugggcuuugugugaagccuuaacucuagcaaccggacccguguccacauugugggaaggaaauccagggagauucuggaacacaaccauugcagugucaauggcaaacaucuuuagagggaguuaccuggcuggagcuggacuucucuuuucuaucaugaagaacacaaccagcacgagaagaggaacuggcaacauaggagaaacgcuaggagagaaauggaaaagcaggcugaacgcauuggggaaaagugaauuccagaucuacaaaaaaaguggaauucaagaaguggacagaaccuuagcaaaagaaggcauuaaaagaggagaaacggaucaucacgcugugucgcgaggcucagcaaaacugagaugguucguugaaagaaauuuggucacaccagaagggaaaguaguggaccuugguugcggcagagggggcuggucauacuauuguggaggauuaaagaauguaagagaagucaaaggcuuaacaaaaggaggaccaggacacgaagaaccuaucccuaugucaacauauggguggaaucuaguacgcuuacagagcggaguugacguuuuuuuuguuccaccagagaagugugacacauuguugugugacauaggggaaucaucaccaaaucccacgguagaagcgggacgaacacucagaguccuuaaccuaguggaaaauugguugaacaauaacacccaauuuugcguaaagguucuuaacccguacaugcccucagucauugaaagaauggaaaccuuacaacggaaauacggaggagccuuggugagaaauccacucucacggaauuccacacaugagauguacuggguguccaaugcuuccgggaacauagugucaucagugaacaugauuucaagaaugcugauuaacagauucaccaugagacacaagaaggccaccuaugagccagaugucgaccucggaagcggaacccgcaauauuggaauugaaagugagacaccgaaccuagacauaauugggaaaagaauagaaaaaauaaaacaagagcaugaaacgucauggcacuaugaccaagaccacccauacaaaacaugggcuuaccauggcagcuaugaaacaaaacagacuggaucagcaucauccauggugaacggaguagucagauugcugacaaaacccugggacguuguuccaauggugacacagauggcaaugacagacacaacuccuuucggacaacagcgcgucuucaaagagaagguggauacgagaacccaagaaccaaaagaaggcacaaaaaaacuaaugaaaaucacggcagaguggcucuggaaagaacuaggaaagaaaaagacaccuagaaugugcaccagagaagaauucacaaaaaaggugagaagcaaugcagccuugggggccauauuuaccgaugagaacaaguggaaaucggcgcgugaggcuguugaagauaguagguuuugggagcugguugacaaggaaagaaaccuccaucuugaagggaaaugugaaacauguguauacaacaugaugggaaaaagagagaaaaaacuaggagaguuugguaaagcaaaaggcagcagagccauaugguacauguggcucggagcacgcuucuuagaguuugaagcccuaggauuuuugaaugaagaccauugguucuccagagagaacucccugaguggaguagaaggagaagggcugcauaagcuagguuacaucuuaagagaggugagcaagaaagaaggaggagcaauguaugccgaugacaccgcaggcugggacacaagaaucacaauagaggauuuaaaaaaugaagaaaugauaacgaaccacauggcaggagaacacaagaaacuugccgaggccauuuuuaaauugacguaucaaaacaagguggugcgugugcaaagaccaacaccaagaggcacaguaauggacaucauaucgagaagagaccaaagggguaguggacaaguugguaccuauggccucaacacuuucaccaacauggaagcacaacuaauuaggcaaauggagggggaaggaaucuucaaaagcauccagcacuugacagccucagaagaaaucgcugugcaagauuggcuaguaagaguagggcgugaaagguugucaagaauggccaucaguggagaugauuguguugugaaaccuuuagaugauagauuugcaagagcucuaacagcucuaaaugacaugggaaagguuaggaaggacauacagcaaugggagcccucaagaggauggaacgacuggacacagguacccuucuguucacaccauuuucacgaguuaauuaugaaagauggucgcacacucguaguuccaugcagaaaccaagaugaauugaucggcagagcccgaauuucccagggagcuggguggucuuuacgggagacggccuguuuggggaagucuuacgcccaaauguggagcuugauguacuuccacagacgugaucucaggcuagcggcaaaugccaucugcucggcagucccgucacacuggguuccaacaagccggacaaccugguccauacacgccagccaugaauggaugacgacggaagacauguugacaguuuggaacaaaguguggauccuagaaaauccauggauggaagacaaaacuccaguggaaucaugggaggaaaucccauaccugggaaaaagagaagaccaauggugcggcucacugauugggcugacaagcagagccaccugggcgaagaauauccagacagcaauaaaccaagucagaucccucauuggcaaugaggaauacacagauuacaugccauccaugaaaagauucagaagagaagaggaagaggcaggaguuuugugguag

SEQ ID NO: 6689 - RNA, 9876 nt, Artificial Sequence
  derived and/or modified CDS sequence (wt) from DENV-2__KF955359__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugggguuaacaugugcacccucauggccauagaccuuggugaauugugugaagauacaaucacguacaaguguccccuccucaggcagaaugaaccagaagacauagauuguuggugcaacuccacguccacauggguaacuuauggaacauguaccaccacaggagaacacagaagggaaaaaagaucaguggcacucguuccacaugugggcaugggacuggagacacgaacugaaacauggaugucaucagaaggggccuggaaacacguucagagaauugaaaccuggaucuugagacauccaggcuuuaccacaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguugggucgacauagucuuagaacauggaaguugugugacgacgauggcaaaaaauaaaccaacauuggauuuugaacugauaaaaacagaagccaaacaaccugccauucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaagggggcauuguaaccugugcuauguucacaugcaaaaagaacauggaaggaaaaguugugcugccagaaaaucuggaauacaccaucgugauaacaccucacucaggagaagagcacgcuguaggcaaugauacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaacuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugaucacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcccuccaccaaguuuucggagcaaucuauggggcugcuuuuaguggggucucauggacuaugaaaauccucauaggaguuaucaucacauggauaggaaugaauucacguagcaccucacugucugcgucacuaguauuggugggaaucgugacacuguacuuggggguuauggugcaggcugacacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucacuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcuuugacgauaaaaggucucaauccaacagccaucuuucuaacaacucuuucgagaaccagcaagaaaaggaguuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagaaagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauuacuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaagguggugcuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggccacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccugguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaacuuuagcaaaagaaggcaucaaaagaggggaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacucaauuuugcguaaagguucucaacccauacaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagcuacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagccuugggggccauauucacugaugagaacaaauggaaaucggcucgugaggcuguugaagauaguagguuuugggaacugguugacagggaaagaaaucuucaucuugaaggaaagugugaaacauguguguacaacaugauggggaaaagagagaagaaacuaggggaguucggcaaggcaaaagguagcagagccauaugguauauguggcuuggagcacguuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaucaaaacaagguggugcguguacaaagaccaacaccaagaggcacaguaauggacaucauaucgagaaaagaccaaagaggcagcgggcaagucggcaccuauggccuuaauacuuuuaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcaugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcgaaugccauuugcucggcagucccaucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6690 - RNA, 9876 nt, Artificial Sequence
  derived and/or modified CDS sequence (wt) from DENV-2__KF955360__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacaugugccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccagugucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaaaaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaagcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggcuggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugacacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagacauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcaguuccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaaguuccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6691 - RNA, 9876 nt, Artificial Sequence
  derived and/or modified CDS sequence (wt) from DENV-2__KF955363__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguuccucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguaggcaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucauuacauggauaggaaugaauucacguagcaccucacugucugugucacuaguauuggugggagucgugacacuguaccugggagcuaugguacaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaguaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuagaaagugagaugauaauuccaaaaaauuuugcugggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugaccuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcggaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaaaaaacaacgagcuggaguauugugggacgucccuucacccccaccagugggaaaagccgaacuggaagauggagccuauagaaucaagcaaagagggauucuuggauauucccagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaggaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacacugggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaaaggcguacaaucaugcucucagugaacugccggaaacccuggagacacugcuuuuacugacacuucuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacacucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauugaugaugaggacuacaugggcucugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauacaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauucacaagaaaggugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggggcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggggcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggucaucaguggagaugauuguguuguaaagccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccgugcagaaaccaagaugaacugauugguagagcccgaauuucccagggagccggguggucuuugaaggagacggccugcuuggggaagucuuacgcccaaauguggacccugauguacuuccacagacgugaccucagacuggcggcaaaugccauuugcucggcagucccgucacauuggguuccaacaagccgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauucaaacagcaauaaaucaagucagaucccuuauaggcaaugaggaauacacagacuacaugccauccaugaagagauuuagaagggaagaggaagaggcagguguccugugguag

SEQ ID NO: 6692 - RNA, 9876 nt, Artificial Sequence
  derived and/or modified CDS sequence (wt) from DENV-2__EU726767__SS-prME
ucugcaggcaugaucauuaugcugauuccaacagugauggcguuucaucuaaccacacguaacggagaaccacacaugaucgucaguagacaagagaaagggaaaagucuucuguuuaaaacagaggauggcgugaacaugugcacccucauggccauggaccuuggugaauugugugaagacacaaucacguacaaguguccccuccucaggcagaaugagccagaagauauagacuguuggugcaacuccacguccacguggguaaccuaugggacuugugccaccacgggagaacauagaagagaaaaaagaucaguggcacucguuccacaugugggaaugggacuggagacgcgaacugaaacauggaugucaucagaaggggcuuggaaacaugcccagagaauugaaacauggauccugagacauccaggcuucaccauaauggcagcaauccuggcauacaccauagggacgacacauuuccagagagcccugauuuucauccuacugacagcuguugcuccuucaaugacaaugcguugcauaggaauaucaaauagagacuuuguagaagggguuucaggaggaagcuggguugacauaguccuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggacaagagguucgucugcaaacacuccaugguagacagaggaugggggaauggauguggauuauuuggaaagggaggcauugugaccugugcuauguucacaugcaaaaagaacauggaagggaaaaucgugcaaccagaaaacuuagaauacaccauugugguaacaccccacucgggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucaucaggaaacuuacucuucacuggacaucucaagugcaggcugagaauggacaagcuacagcucaaaggaaugucauacucuaugugcacaggaaaguucaaaguugugaaggaaauagcagaaacacaacauggaacgauaguuaucagagugcaauaugaaggggacggcuccccauguaaaaucccuuuugagauaauggauuuggaaaaaagauaugucuuaggccgccuaaucacagucaacccaauugugacagaaaaagauagcccagucaacauagaagcagaaccuccauucggagacagcuacaucaucauaggaguagagccgggacaacugaagcucaauugguuuaagaaaggaaguucuauuggccaaauguuugagacaacaaugaggggggcgaagagaauggccauuuugggugacacagccugggauuucggaucccugggaggaguguuuacaucuauaggaaaagcucuccaccaagucuuuggagcaaucuauggagcggccuucagugggguuucauggacuaugaaaauccucauaggagucauuaucacauggauaggaaugaauucacgcagcaccucacuguccgugucacuaguauuggugggaauugugacacuguauuugggagucauggugcaggccgauagugguugcgucgugagcuggaaaaacaaagaacugaaauguggcaguggaauuuucaucacagacaacgugcacacauggacagaacaauacaaguuccaaccagaauccccuucaaaacuggcuucagcuauccagaaagcucaagaagagggaauuuguggaauccgcucaguaacaagauuggagaaucuaauguggaaacaaauaacaccagaauugaaucacauuuuagcagaaaaugaggugaaguuaacuaucaugacaggagacgucaaaggaaucaugcaggcaggaaaacgaucucugcggccucagcccacugagcuaaaguauucauggaaaacauggggcaaagcaaaaaugcucuccacagagucccauaaccaaaccuuucucauugauggccccgaaacagcagaaugccccaacacaaauagagcuuggaacucgcuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaucauacacaaauagcaggaccauggcaucuagguaagcuugagauggacuuugauuucugcgaaggaacuacagugguagugacugaggacugcggaaauagaggacccucuuugagaacaaccacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcauuguuccuggaggaaaugcuuaggacccgaguaggaacgaaacaugcaauacuacuaguugcaguuucuuuuaugacauugaucacagggaacauguccuucaaagaccuaggaagaguggugguuaugguaggcgccgccaugacggaugacauaggcaugggcgugacuuaucuugcccuacuagcagccuucaaaguuagaccaacuuuugcagcuggacuacuccugagaaagcugaccuccaaggaauugaugaugacuaccauaggaauugcacuccucucccaaagcaccauaccagagaccauucuugaauugacugaugcguuagccuuaggcaugaugguccucaaaaugguaagaaacauggaaaaguaucaauuagcagugaccaucauggcuaucuugugugucccaaacgcagugauauuacaaaaugcauggaaagugaguuguacaauacuggcagugguguccguuuccccacugcuuuugacuuccucacagcaaaaaacggauuggauaccauuagcauugacaaucaagggucucaauccaacagccauuuuucuaacaacccucucaagaaccaguaagaaaaggagcuggccacugaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcgaccgaugucaaaugggaagaccaggcagagauaucaggaagcaguccaauccugucaauaacaauaucagaagaugguagcaugucgauaaaaaaugaagaggaagaacagacacugaccauacucauuagaacaggauugcuggugaucucaggacuuuuuccuguaucaauaccgauuacggcagcagcaugguaccugugggaagugaagaaacaacgggccggaguauugugggauguuccuucacccccacccaugggaaaggcugaacuggaagauggagccuacagaaucaagcaaaaagggauucuuggauauucccagaucggagcuggaguuuacaaagaaggaacauuccauacaauguggcaugucacacguggcgcuguccuaaugcacaaaggaaagaggauugaaccgucaugggcggacguaaaaaaagaucuaauaucauauggaggaggcuggaaguuagaaggagaauggaaggaaggagaagaaguccaggugcuggcauuggagccuggaaaaaauccaagagccguccaaacaaaaccuggucuuuucaaaaccaacgccggaacaauaggugccguaucucuggacuuuuccccuggaacgucgggaucuccaaucauugacaaaaaaggaaaaguuguaggucuuuaugguaaugguguuguuacaaggaguggagcauaugugagugcuauagcccaaacugaaaaaagcauugaagacaacccagagaucgaagaugacauauuccgaaagagaagacugaccaucauggaccuccacccaggagcgggaaagacgaaaagauaccuuccggccauagucagagaagcuauaaaacgggguuugagaacauuaaucuuggcccccaccagaguaguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaaccugauuaucauggacgaagcccauuucacagacccagcaaguauagcagcuagaggauacaucucaacucgaguggagaugggugaggcagcugggauuuucaugacggccacuccuccgggaagcagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaggcugagaggguuauagaccccagacguugcaugaaaccagucauacuaacagauggugaggagcgggugauccuggcaggacccaugccagugacccacucuagugcagcacaaagaagagggagaauagggagaaauccaaaaaaugaaaaugaccaguacauauacaugggggaaccucuggaaaaugaugaagacugugcacacuggaaagaagccaaaaugcuccuagauaacaucaacacaccagaaggaaucauucccaguauguuugagccagaacgugaaaaaguggaugccauugauggcgaauaccgcuugagaggagaagcaaggaaaaccuuuguggacuugaugagaagaggagaccuaccagucugguuggccuacaaaguggcagcugaaggcaucaacuaugcagacagaaggugguguuuugauggaaucaagaacaaccaaaucuuggaagaaaauguggaaguugaaaucuggacaaaagaaggggaaaggaagaaauugaaacccagauggcuggaugcaaggauuuauucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuggagacacugcuuuuacugacacuucuggcuacagucacgggagggaucuuuuuauucuugaugagcgggaggggcauagggaagaugacccugggaaugugcugcauaaucacggcuagcauccuucuaugguacgcucaaauacagccacacuggauagcagcuucaauaauacuggaguuuuuucuuauaguuuugcuuauuccagaaccagaaaaacagagaacaccccaagacaaucaauugaccuacguugucauagccauccucacagugguggccgcaaccauggcaaacgagauggguuuccuagaaaaaacgaagaaagaucuuggacuaggaagcauuguaacccagcaacccgagagcaacauccuggacauagaucuacgccccgcaucagcguggacgcuguaugccguggccacaacauuugucacaccaaugcugagacauagcauugagaauuccucagugaauguaucccuaacagcuauagccaaccaagcaacaguguugaugggucuagggaaaggauggccguugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcagcuggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggccuaucuccacacugugggaaggaaauccaggaagguucuggaacaccaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauucaggaaguggauagaaccuuagcaaaagaaggcaucaaaagaggagaaacggaccaucacgcugugucacgaggcucagcaaaacugagaugguucguugagagaaauauggucacaccagaagggaaaguaguggaccucgguuguggcagaggagguuggucauacuauuguggaggacuaaaaaacguaagagaagugaaaggccuaacaaaaggaggaccaggacaugaagaacccauccccaugucaacauauggguggaaccuagugcgucuucaaaguggaguugacguuuucuucaucccgccagaaaagugugacacauuguugugugacauaggggagucaucaccaaaccccacaguggaagcaggacgaacacucagaguccuuaauuuaguagaaaauugguugaacaacaacacucaauuuugcauaaagguucucaacccauauaugcccucaguuauagaaaaaauggaagcacugcaaaggaaauauggaggagccuuagugagaaauccacucucacggaacuccacacaugagauguacuggguauccaacgcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaacuuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccgugggacguccuucccacggugacacagauggcaaugacagacacgacuccauuuggacaacagcgugucuuuaaagaaaaaguggacacgagaacccaagaaccgaaagaaggcacgaagaaacuaaugaaaaucacggcagaguggcuguggaaagaauuagggaagaaaaagacaccuaggaugugcaccagagaagaauuuacaagaaaggugagaagcaaugcagccuugggggccguauucacugaugagaacaaguggaagucggcacgugaggcuguugaagauaguagguuuugggagcugguugacaaggaaaggagucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaccaaaacaagguggugcgugugcaaagaccaacaccaagaggcacaguaauggacauuauaucgagaagagaccaaagagguagugggcaaguuggcaccuauggacucaauacuuucaccaacauggaagcccaauuaaucagacagauggagggagaaggagucuuuaaaaacauucagcacuugacagucacagaagaaaucgccgugcaaaacugguuagcaaggguggggcgcgaaagguuaucaagaauggccaucaguggagaugauuguguugugaaaccuuuagaugacagguuugcaagcgcuuugacagcucugaaugacaugggaaagauuagaaaggacauacaacaaugggaaccuucaagaggauggaacgauuggacacaaguccccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcggugccaucacauuggguuccaacaagucgaacaaccugguccauacacgccaaacaugaauggaugacaacggaagacaugcugacagucuggaacagaguguggauucaagaaaacccauggauggaagacaaaaccccaguggaaucaugggaggaaaucccauacuugggaaaaagagaagaccaauggugcggcucacugauuggguuaacaagcagggccacaugggcaaagaacauccaagcagcaauaaaucaaguuagaucucucauaggcaaugaggaauacacagauuauaugccauccaugaaaagauucagaagagaagaggaagaagcaggaguccugugguag

SEQ ID NO: 6693 - RNA, 9876 nt, Artificial Sequence
  derived and/or modified CDS sequence (wt) from DENV-2__EU687246__SS-prME
ucugcaggcaugaucaucaugcugauuccaacaguaauggcguuccaucuaaccacacgcaacggagaaccacacaugaucgucaguauacaagagaaagggaaaagucuucuguuuaagacagaggauggcgugaacaugugcacccuuauggcuauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacuuguuccacaugugggaaugggacuggagacgcgaaccgaaacauggaugucaucagaaggggcuuggaaacaugcccagagaaucgaaacuuggauccugagacauccaggcuucaccauaauggcagcaauccuggcauacaccauagggacgacacauuuccagagagccuugauuuucauccuacugacagcugucgcuccuucaaugacaaugcgcugcauaggaauaucaaauagagacuuuguagaagggguuucaggaggaagcuggguugacauagucuuagaacauggaagcugcgugacgacgauggcaaaaaacaaaccaacauuggauuuugaacugauaaaaacggaagccaaacagccugccacccuaagaaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggacacacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacacggaacgauaguuaucagagugcaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaagcucuaucggccaaauguuugagacaacaaugaggggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguauugguaggaauugugacacuguauuugggagucauggugcaggccgauagugguugcguugugagcuggaaaaacaaagaacugaaauguggcagugggauuuucaucacagacaacgugcacacguggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucugcggccccagcccacugagcuaaaguauucauggaaaacauggggcaaagcaaaaaugcucuccacagagucucauaaccaaaccuuccuuauugauggccccgaaacagcagaaugccccaauacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacagugguagugacugaggacugcggaaauagaggacccucuuugagaacaacuacugccucaggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucauuaggagucuugggaauggcauuguuccuggaggaaaugcuuaggacccgaguaggaacgaaacaugcaauacuacuaguugcacuuucuuuugugacauugaucacagggaacauguccuuuaaagaccuaggaagaguggugguuauggugggcgccaccaugacggaugacauagguauggguguaacuuaucuugcccuacuagcagccuucaaagucagaccaacuuuugcagcuggacuacucuugagaaaacugaccuccaaggaauugaugaugacuaccauaggaauuguacuccucucccaaagcaauauaccagagaccauucuugaauugacugaugcguuagccuuaggcaugaugguccucaaaauaguaagagacauggaaaaguaucaauuagcagugacuaucauggcuaucuugugcgucccaaacgcagugauauuacaaaaugcauggaaagugaguugcacaauacuagcagugguguccguuuccccacugcuuuugacauccucacagcaaaaaacggauuggauaccauuagcauugacaaucaaaggucucaauccaacagccauuuuucuaacaacccucucaagaaccaacaagaaaaggagcuggccacuaaaugaggcuaucauggcagucggaauggugagcauuuuagcuaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcugguaaucucaggacuuuuuccuguaucaauaccaaucacggcagcagcaugguaccugugggaagugaagaaacaacgggccggaguauugugggauguuccuucacccccacccaugggaaaggcggaacuggaagauggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccagacugaaaaaagcauugaagacaacccagacaucgaagaugacauuuuccgaaagagaagacugaccaucauggaccuccacccaggagcgggaaagacgaaaagauaccuuccggccauagucagagaagccauaaaacgggguuugagaacauuaaucuuggcccccaccagaguuguggcagcugaaauggaggaagcucucagaggacuuccaauaagauaccaaaccccagccaucagagcugaacacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucggguggagaugggugaagcagcugggauuuucaugacagccacuccaccgggaagcagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaagugauacaacuuaguaggaagacuuuugauucugaguauaucaagacuagaaccaaugauugggauuucgugguuacaacugacauuucagaaaugggugccaauuucaaggcugagaggguuauagaccccagacgcugcaugaaaccagucauauuaacagauggugaggagcgggugauucuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacauaaacacaccagaaggaaucauucccaguauguuugaaccagagcgugaaaagguggaugccauugauggcgaauaccgcuugagaggagaagcaaggaaaaccuuuguggaccuaaugagaagaggagaccuaccagucugguuggccuacaaaguggcagcugaaggcaucaacuaugcagacagaaggugguguuuugauggaaucaagaacaaccaaauccuggaagagaauguggaaguugaaauauggacaaaagaaggggaaaggaagaaauugaaacccagauggcuggaugcuaggaucuacucugacccacuggcgcuaaaagaauucaaagaauuugcagccggaagaaagucucugacccugaaccuaauuacagaaaugggcaggcuuccaacauucaugacucagaagacaagagacgcacuggacaacuuagcagugcugcacacggcugaagcagguggaagggcguacaaucaugcucucagugaacugccggagaccuuggagacacugcuuuuacugacacuucuggcuacagucacgggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuauguugucauagccauccucacagugguggccgcaaccauggcaaacgagauggguuuccuagaaaaaacgaagaaagaucuuggauuaggaagcauugcaacccagcaacccgagagcaacauccuggacauagaucuacgccccgcaucagcauggacgcuguaugccguggcuacaacauuuauuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggaugcuacucacaagucaaucccauaacucucacagcagcucuucucuuauugauagcgcauuaugccaucauagggccaggacuucaagcaaaagcaaccagagaagcucagaaaagagcagcggcgggcaucaugaaaaacccaaccgucgacggaauaacagugauugaucuagauccaauaccuuaugauccaaaguucgaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaaccuauccccaugucaacauauggguggaaucuagugcgucuucaaaguggaguugacguuuucuucaucccgcccgaaaagugugacacauuguugugugacauaggggagucaucaccaaauccuacaguggaagcaggacgaacacucagaguccuuaauuuaguagaaaacugguugaacaacaacacucaauuuugcauaaaaguucucaacccauauaugcccucaguuauagaaaaaauggaaacacugcaaaggaaauauggaggagccuuggugagaaauccacucucacggaacuccacacaugagauguacuggguauccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacggugacacagauggcaaugacagacacgacuccauuuggacaacagcguguuuucaaagaaaaaguggacacgagaacccaagaaccgaaagaaggcacgaagaaacuaaugaagaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaacuagccgaggcuauuuucaaacuaacguaccaaaacaagguggugcgugugcaaagaccaacaccaagaggcacaguaauggacaucauaucgagaagagaccaaagagguagugggcaaguugguaccuauggacucaauacuuucaccaauauggaagcccaauugaucagacagauggagggagaaggaguuuuuaaaaacauucagcaccugacagucacagaagaaaucgccgugcaaaacuggcuagcaagaguggggcgcgaaagguuaucaagaauggccaucaguggagaugauuguguugugaaaccuuuagaugacagguucgcaagcgcuuugacagcucuaaaugacaugggaaagauuagaaaagacauacaacaaugggaaccuucaaggggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucagguuggcggcaaaugccauuugcucggcagugccaucacauugggugccaacaagucgaacaaccugguccauacacgccaaacaugaauggaugacaacggaagacaugcugacagucuggaauaggguguggauucaggaaaacccauggauggaagacaaaaccccaguggaaucaugggaggaaaucccauacuuggggaaaagagaagaccaauggugcggcucauugauuggguuaacaagcagggccacaugggcaaagaacauccaagcagcaauaaaucaaguuagaucucuuauaggcagugaggaauacacagauuacaugccauccaugaaaagauucagaagagaagaggaagaagcaggaguccugugguag

SEQ ID NO: 6694 - RNA, 9876 nt, Artificial Sequence
  derived and/or modified CDS sequence (wt) from DENV-2__FJ639828__SS-prME
ucuguaggcaugaucauuaugcugauuccaacaguaauggcguuccaucuaaccacacgcaacggagaaccacacaugaucgucaguauacaagagaaaggaaaaagccuucuguuuaaaacagaggauggcgugaacaugugcacccucauggccauggaccuuggugaauugugugaagacacaaucacguacaaguguccccuucucaggcagaaugagccagaagacauagacugcuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaacccugauuuucauccuacugacagcugucgcuccuucaaugacaaugcguugcauaggaauaucaaauagagacuuuguagaaggggucucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucgcugcccaacacaaggggaacccagccuaaaagaagagcaggauaagagguucgucugcaaacacuccaugguagacagaggauggggaaauggauguggauuauuuggaaaaggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauugccauggcugcccggagcggauacacaagggucaaauuggauacagaaagaaacauuggucacuuucaaaaauccccaugcgaagaaacaggaugucguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacgauaguuaucagaguacaauaugaaggggacggcucuccauguaaaaucccuuuugagauaauggauuuggaaaaaagauaugucuuaggccgccugaucacagucaacccaauugcgacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggauccuugggaggaguguuuacaucuauaggaaaagcccuccaccaagucuuuggagcaaucuauggagcugccuucagugggguuucauggacuaugaaaauccucauaggagucauuaucacauggauaggaaugaacucacgcagcaccucacugucugugucacuaguauuggugggaguugugacacuguauuugggagucauggugcaggccgauagugguugcgucgugagcuggaaaaacaaagaacugaaauguggcagugggauuuucaucacagacaacgugcacacauggacagaacaauacaaguuccaaccagaauccccuucaaaacuagcuucagccauccaaaaagcucaagaagagggaauuugugggauccgcucaguaacaagauuggagaaccuaauguggaaacaaauaacaccagaauugaaucacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggccccgagacagcagaaugccccaacacaaauagagcuuggaacucguuggaaguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaggccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccuccggaaaacucauaacagaauggugcugucgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcacuguuccuggaggaaaugcuuaggacccgaguaggaacgaaacaugcgauacuacuaguugcaguuucuuuugugacauugaucacagggaacauguccuuuaaagaucuaggaagaguggugguuaugguaggcgccaccaugacggaugacauagguaugggcguaacuuaucuugcccuacuagcagccuucaaagucagaccaacuuuugcagcaggacuauucuugagaaagcugaccuccaaggaauugaugaugacuaccauaggaauuguacuccucucccagagcacuuuaccagaaaccauccuugaauugacugaugcguuagccuuaggcaugaugguccucaaaaugguaagagacauggaaaaguaucaauuagcagugaccaucauggcuaucuugugcgucccaaaugcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucugacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacagcagcagcaugguaccugugggaagugaagaaacaacgggccggaguauugugggauguuccuucacccccacccaugggaaaggcugaacuggaagauggagccuacagaaucaagcaaagagggauucuuggauauucccagaucggagcuggaguuuauaaagaaggaacauuccauacgauguggcaugucacacguggcgcuguccuaacgcauaaaggaaagaggauugaaccaucaugggcggacguuaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauacgugagugccauagcccaaacugaaaaaagcauugaagacaacccagacaucgaagacgacauuuuccgaaagagaagacugaccaucauggaccuccacccaggagcgggaaagacgaaaagauaccuuccggccauagucagagaagccauaaaacgggguuugagaacauuaaucuuggcccccaccagaguuguggcagcugaaauggaggaagcucucagaggacucccaauaagauaccaaaccccagccaucagagcugagcacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccaaucauagaugaagaaagagaaaucccugaacguucauggaauucuggacaugagugggucacggauuuuaaaggaaaaacuguuugguuuguuccaagcauaaaagcaggaaaugauauagcagccugccugagaaagaauggaaagaaaguaauacaacuuagcaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaucaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggacgccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaaccccgaugguuggaugcuaggaucuacucugacccacuggcgcuaaaagaauucaaagaauuugcagccggaagaaagucucugacccugaaccuaauuacagaaauggguaggcuuccaacguucaugacccagaagacaagagacgcacuggauaacuuagcagugcugcacacggccgaagcagguggaagggcguacaaucaugcucucagugaacugccggagacccuggagacacugcuuuuacugacacuucuggccacagucacgggagggaucuuuuuauucuugaugagcgggaggggcauagggaagaugacccuaggaaugugcugcauagucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaagacgaagaaagaucuuggauuaggaagcauugcaacccagcagcccgagagcaacauccuggacauagaucuacgccccgcaucagcauggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggagcuccccuucucgccauuggaugcuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaauacuaccauugcggugucaauggcuaacaucuuuagagggaguuacuuggcuggagcuggacuucucuuuuccauuaugaagaacacaaccaacucaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcauuaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccugacaaaaggaggaccaggacacgaagaacccaucccuaugucaacauauggguggaaucuagugcgccuucaaaguggaguugacguuuucuucaucccgccagaaaagugugacacauuguugugugacauaggggagucaucaccaaauccuacaguggaagcaggacgaacacucagaguccuuaauuugguagaaaauugguugaacaacaacacucaauuuugcauaaaaguucuuaacccauacaugcccucaguuauagaaaaaauggaaacacugcaaaggaaauauggaggagccuuagugagaaauccacucucacggaacuccacacaugagauguacuggguuuccaaugcuuccgggaacauagugucaucagugaacaugauuucaaggauguugaucaauagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauauaaaacaugggcauaccauggcagcuaugaaacaaaacagacuggaucagcaucauccauggucaauggaguggucaggcuguugacaaaaccuugggacguccuccccaccgugacacagauggcaaugacagacacgacuccauuuggacaacagcguguuuuuaaagaaaaaguggacacgagaacucaagaaccgaaagaaggcacgaagaaacuaaugaaaaucacagcagaguggcuguggaaggaauuagggaagaaaaagacaccuaggaugugcaccagagaagaauuuacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaggcuagguuacauucugagagacgugagcaagaaagagggaggagccauguaugccgaugacacagcaggaugggacacaagaauuacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggaguuuuuaaaaacauucagcaccugacagucacagaagaaaucgccgugcagaacugguuagcaagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugcccuucuguucacaccauuuccaugaacuaaucaugaaggauggucguguacuuguuguuccaugcagaaaccaagaugaacugauuggcagagcccgaaucucccaaggagcagggugguccuugcgggagacggccuguuuggggaagucuuacgcccaaauguggagcuugauguauuuccacagacgcgaccucagguuagcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguagaaucaugggaggaaaucccguacuuggggaaaagagaagaucaauggugcggcucauugauuggguuaacaagcagggccacaugggcaaagaacauccaagcagcaauaaaucaaguuagaucucuuauaggcaaugaggaauacacagacuacaugccauccaugaaaagauucagaagagaagaggaagaagcaggaguccugugguag

SEQ ID NO: 6695 - RNA, 9876 nt, Artificial Sequence
  derived and/or modified CDS sequence (wt) from DENV-2__FJ639829__SS-prME
ucuguaggcaugaucauuaugcugauuccaacaguaauggcguuccaucuaaccacacgcaacggagaaccacacaugaucgucaguauacaagagaaaggaaaaagccuucuguuuaaaacagaggauggcgugaacaugugcacccucauggccauggaccuuggugaauugugugaagacacaaucacguacaaguguccccuucucaggcagaaugagccagaagacauagacugcuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaacccugauuuucauccuacugacagcugucgcuccuucaaugacaaugcguugcauaggaauaucaaauagagacuuuguagaaggggucucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucgcugcccaacacaaggggaacccagccuaaaagaagagcaggauaagagguucgucugcaaacacuccaugguagacagaggauggggaaauggauguggauuauuuggaaaaggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggaugucguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacgauaguuaucagaguacaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggauccuugggaggaguguuuacaucuauaggaaaagcccuccaccaagucuuuggagcaaucuauggagcugccuucagugggguuucauggacuaugaaaauccucauaggagucauuaucacauggauaggaaugaacucacgcagcaccucacugucugugucacuaguauuggugggaguugugacacuguauuugggagucauggugcaggccgauagugguugcgucgugagcuggaaaaacaaagaacugaaauguggcagugggauuuucaucacagacaacgugcacacauggacagaacaauacaaguuccaaccagaauccccuucaaaacuagcuucagccauccaaaaagcucaagaagagggaauuugugggauccgcucaguaacaagauuggagaaccuaauguggaaacaaauaacaccagaauugaaucacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaucaaaccuuucucauugauggccccgagacagcagaaugccccaacacaaauagagcuuggaacucguuggaaguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaggccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcacuguuccuggaggaaaugcuuaggacccgaguaggaacgaaacaugcgauacuacuaguugcaguuucuuuugugacauugaucacagggaacauguccuuuaaagaucuaggaagaguggugguuaugguaggcgccaccaugacggaugacauagguaugggcguaacuuaucuugcccuacuagcagccuucaaagucagaccaacuuuugcagcaggacuauucuugagaaagcugaccuccaaggaauugaugaugacuaccauaggaauuguacuccucucccagagcacuauaccagaaaccauccuugaauugacugaugcguuagccuuaggcaugaugguccucaaaaugguaagagacauggaaaaguaucaauuagcagugaccaucauggcuaucuugugcgucccaaaugcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucugacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaauuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacagcagcagcaugguaccugugggaagugaagaaacaacgggccggaguauugugggauguuccuucacccccacccaugggaaaggcugaacuggaagauggagccuacagaaucaagcaaagagggauucuuggauauucccagaucggagcuggaguuuauaaagaaggaacauuccauacgauguggcaugucacacguggcgcuguccuaacgcauaaaggaaagaggauugaaccaucaugggcggacguuaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauacgugagugccauagcccaaacugaaaaaagcauugaagacaacccagacaucgaagacgacauuuuccgaaagagaagacugaccaucauggaccuccacccaggagcgggaaagacgaaaagauaccuuccggccauagucagagaagcuauaaaacgggguuugagaacauuaaucuuggcccccaccagaguuguggcagcugaaauggaggaagcucucagaggacucccaauaagauaccaaaccccagccaucagagcugagcacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccaaucauagaugaagaaagagaaaucccugaacguucauggaauucuggacaugagugggucacggauuuuaaagggaaaacuguuugguuuguuccaagcauaaaagcaggaaaugauauagcagccugccugagaaagaauggaaagaaaguaauacaacuuagcaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacucacucuagugcagcacaaagaagagggagaauaggaagaaauccaaaaaaugaaaaugaucaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggacgccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaaccccgaugguuggaugcuaggaucuacucugacccacuggcgcuaaaagaauucaaagaauuugcagccggaagaaagucucugacccugaaccuaauuacagaaauggguaggcuuccaacguucaugacccagaagacaagagacgcacuggauaacuuagcagugcugcacacggccgaagcagguggaagggcguacaaucaugcucucagugaacugccggagacccuggagacacugcuuuuacugacacuucuggccacagucacgggagggaucuuuuuauucuugaugagcgggaggggcauagggaagaugacccuaggaaugugcugcauagucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaagacgaagaaagaucuuggauuaggaagcauugcaacccagcagcccgagagcaacauccuggacauagaucuacgccccgcaucagcauggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggagcuccccuucucgccauuggaugcuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacucaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcauuaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgccuucaaaguggaguugacguuuucuucaucccgccagaaaagugugacacauuguugugugacauaggggagucaucaccaaauccuacaguggaagcaggacgaacacucagaguccuuaauuugguagaaaauugguugaacaacaacacucaauuuugcauaaaaguucuuaacccauacaugcccucaguuauagaaaaaauggaaacacugcaaaggaaauauggaggagccuuagugagaaauccacucucacggaacuccacacaugagauguacuggguuuccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauauaaaacaugggcauaccauggcagcuaugaaacaaaacagacuggaucagcaucauccauggucaauggaguggucaggcuguugacaaaaccuugggacguccuccccaccgugacacagauggcaaugacagacacgacuccauuuggacaacagcguguuuuuaaagaaaaaguggacacgagaacucaagaaccgaaagaaggcacgaagaaacuaaugaaaaucacagcagaguggcuguggaaggaauuagggaagaaaaagacaccuaggaugugcaccagagaagaauuuacaagaaaggugagaagcaaugcagccuugggggccauauucacugaugagaauaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaggcuagguuacauucugagagacgugagcaagaaagagggaggagccauguaugccgaugacacagcaggaugggacacaagaauuacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggaguuuuuaaaaacauucagcaccugacagucacagaagaaaucgccgugcagaacugguuagcaagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugcccuucuguucacaccauuuccaugaacuaaucaugaaggauggucguguacuuguuguuccaugcagaaaccaagaugaacugauuggcagagcccgaaucucccaaggagcagggugguccuugcgggagacggccuguuuggggaagucuuacgcccaaauguggagcuugauguauuuccacagacgcgaccucagguuagcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguagaaucaugggaggaaaucccguacuuggggaaaagagaagaucaauggugcggcucauugauuggguuaacaagcagggccacaugggcaaagaacauccaaguagcaauaaaucaaguuagaucucuuauaggcaaugaggaauacacagacuacaugccauccaugaaaagauucagaagagaagaggaagaagcaggaguccugugguag

SEQ ID NO: 6696 - RNA, 9876 nt, Artificial Sequence
  derived and/or modified CDS sequence (wt) from DENV-2__FJ639831__SS-prME
ucugcaggcaugaucauuaugcugauuccaacaguaauggcguuccaucuaaccacacgcaacggagaaccacacaugaucgucagcauacaagagaaagggaaaagucuucuguuuaagacugaggauggcgugaacaugugcacccucauggccauggaccuuggugaauugugugaagacacaaucacguacaaguguccccuucuaaggcagaaugagccagaagacauagacuguuggugcaacuccacauccacguggguaaccuaugggacuuguaccaccacgggagaacauagaagagaaaaaagaucaguggcacuuguuccacaugugggaaugggacuggagacgcgaaccgaaacauggaugucaucagaaggggcuuggaaacaugcccagagaaucgaaacuuggauccugagacauccaggcuucaccauaauggcagcaauccuggcauacaccauagggacgacacauuuccagagagccuugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguuguccaacacaaggggaacccagccuaaaagaagagcaggauaagagguucgucugcaaacacuccauaguagacagaggguggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccgucacagaagcagaauugacagguuauggcaccgucacgauggagugcucuccgagaacaggccucgauuucaaugagaugguguugcugcagauggaaaauaaagcuuggcuggugcauaggcaaugguuccuagaccugccauuaccauggcugcccggagcggacacacaagggucaaauuggauacagaaagaaacauuggucacuuucaaaaauccccaugcgaagaaacaggauguuguuguuuuaggaucccaagaaggggccaugcauacagcacucacaggggccacagaaauccaaaugucgucaggaaacuuacucuucaccggacaucucaagugcaggcugagaauggacaagcuacagcucaaaggaaugucauacuccaugugcacaggaaaguucaaaguugugaaggaaauagcagaaacacaacauggaacgauaguuaucagagugcaauaugaaggggacggcucuccauguaaaaucccuuuugagauaauggacuuggaaaagagauaugucuuaggccgccugaucacagucaacccaauugugacagaaaaagauagcccagucaacauagaagcagaaccuccauucggagacagcuacaucaucauaggaguagagccaggacaacugaagcucaacugguucaagaaaggaaguucuaucggccaaauguuugagacaacaaugaggggggcgaagagaauggccauuuugggugacacagccugggacuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguacugguaggaauugugacacuguacuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugagguaaaauuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucuuauugauggccccgaaacagcagaaugccccaacacaaauagagcuuggaacucguuggagguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagcuucuuucauugaaguaaaaaacugccacuggccaaagucacacacccucuggaguaauggagugcuagaaagcgagaugauaauuccaaagaaucucgcuggaccagugucucaacacaacuauagaccaggcuaccauacacaaauagcaggaccauggcaucuagguaagcuugagauggacuuugacuucugcgauggaaccacagugguagugacugaggacugcggaaauagaggacccucuuuaagaacaacuacugcuucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagauugacaauuuuucacuaggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuauggugggcgccaccaugacggaugacauaggcaugggcguaacuuaucuugcccuacuagcagccuucaaagucagaccaacuuuuguagcuggacuacucuugagaaaacugaccuccaaggaauugaugaugacuaccauaggaauuguacuccucucccaaagcacuauaccagagacuauucuugaauugacugaugcgcuagccuuaggcaugaugguccucaaaauaguaagagacauggagaaguaucaauuagcagugacuaucauggcuaucuugugcgucccaaacgcagugauauuacaaaaugcauggaaagugaguugcacaauacuagcagugguauccguuuccccacugcuuuugacauccucacagcaaaaaacggauuggauaccauuagcauugacaaucaagggucucaauccaacagccauuuuucuaacaacucucucaagaaccaacaagaaaaggagcuggccacuaaaugaggcuaucauggcagucggaauggugagcauuuuagccaguucucuccuaaaaaaugacauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccuaugggaaguaaagaaacaacgggccggaguauugugggauguuccuucacccccacccaugggaaaggcugaacuggaagauggagccuacagaaucaagcaaaaagggguucuuggguauucccagaucggagcuggaguuuauaaagaaggaacauuccauacaauguggcaugucacacguggcgcuguccuaaugcacaaaggaaagaggauugaaccaucaugggcggacgucaaaaaagaucuaauaucauauggaggaggcuggaagcuggaaggagaauggaaggaaggagaagaaguccaggugcuggccuuggagccuggaaaaaauccaagagcuguccaaacaaaaccuggucuuuucaagaccaacacuggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaacccagacaucgaagaugacauuuuccgaaagagaagacugaccauuauggaccuccauccaggagcgggaaagacgaaaagauaccucccggccauagucagagaagcuauaaaacgggguuugagaacauuaaucuuggcccccaccagagucguggcagcugaaauggaggaagcucucagaggacuuccaauaagauaccaaaccccagccaucagagcugagcauacagggcgggaaauuguggaucuaaugugucaugccacauuuaccaugaggcugcuaucaccaguuagagugccaaacuacaacuugauuaucauggaugaagcccauuucacagacccagcaaguauagcagcuagaggauacaucucaacucgaguggagaugggugaagcagcugggauuuuuaugacagccacuccuccgggaagcagagauccauuuccucagagcaaugcaccaaucauagaugaagaaagagaaaucccugaacguucauggaauucuggacaugagugggucacggauuuuaaagggaagacugucugguucguuccaagcauaaaagcagggaaugauauagcagcuugccugagaaaaaauggaaagaaagugauacaacuuaguaggaagacuuuugacucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauccuggcaggaccuaugccagugacccacucuagugcagcgcaaagaagagggaggauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaagguggaugccauugauggcgaauaucgccugagaggagaagcaaggaaaaccuuuguggaccuaaugagaagaggagaccuaccaguuugguuggccuacaaaguggcagcugaaggcaucaacuaugcagacagaaggugguguuuugauggaaucaagaacaaccaaauccuggaagagaauguagaaguugaaaucuggacaaaagaaggggaaaggaaaaaauugaaacccagauggcuggaugcuaggaucuacucugacccacuggcgcuaaaagaauucaaagaauuugcagccggaagaaagucucugacccugaaccuaauuacagaaauggguaggcuuccaacauucaugacucagaagacuagagacgcacuggacaacuuagcagugcugcacacggcugaggcagguggaagggcguacaaucaugcucucagugaacugccggagacccuggagacacugcuuuuacugacacuucuggcuacagucacgggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaaaacgaagaaagaucuuggauuaggaagcaucacaacccagcaacccgagagcaacauccuggacauagaucuacgccccgcaucagcauggacgcuguaugccguggcuacaacauuuguuacaccaaugcugagacauagcauugagaauuccucagugaauguaucccuaacagccauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccauuauagggccaggacuucaagcaaaagcaaccagagaagcucagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggaccacaugggcuaugugugaggccuuaaccuuagcuaccgggcccaucuccacauugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagaaacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccugacaaaaggaggaccaggacacgaagaacccauccccaugucaacauauggguggaaucuagugcgucuucaaaguggaguugacguuuucuucaucccgcccgaaaagugugacacauugcugugugacauaggggagucaucaccaaauccuacaguggaagcaggacgaacacucagaguccuuaauuuaguagaaaauugguugaacaacaacacucaauuuuguauaaaaguccucaacccauauaugcccucaguuauagaaaaaauggaaacacugcaaaggaaauauggaggagccuuagugagaaauccacucucacggaacuccacacaugagauguacuggguauccaacgcuuccgggaacauagugucaucagugaacaugauuucaaggauguugaucaacagauuuacaaugagacacaagaaaaccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaagcuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagaaaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaauacuuucaccaauauggaagcccaguugaucagacagauggagggagaaggaguuuuuaaaaauauucagcaccugacagucacagaagaaaucgccgugcaaaacugguuagcaagaguggggcgcgaaagguuaucaagaauggccaucaguggagaugauuguguugugaaaccuuuagaugacagguucgcaagcgcuuugacagcucuaaaugacaugggaaagauuagaaaagacauacaacaaugggaaccuucaagaggauggaacgauuggacacaagugcccuucugcucacaccauuuccaugagcuaaucaugaaggauggucguguacuuguuguuccaugcagaaaccaagaugaacugauuggcagagcccgaaucucccaaggagcaggguggucuuugcgggagacggcuuguuuggggaagucuuacgcccaaauguggagcuugauauauuuccacagacgcgaccucagguuggcggcaaaugccauuugcucggcagugccaucacauuggguuccaacaagccgaacaaccugguccauacacgccaaacaugaauggaugacaacggaagacaugcugacagucuggaauaggguguggauucaggaaaacccauggauggaagacaaaaccccaguggaaucaugggaggaaaucccauacuuggggaaaagagaagaucaaugguguggcucacugauuggguuaacaagcagggccacaugggcaaagaacauucaaacagcaauaaaucaaguuagaucucuuauaggcaaugaggaauacacagauuacaugccauccaugaaaagauucagaagagaagaggaagaagcaggaguccugugguag

SEQ ID NO: 6697 - RNA, 9876 nt, Artificial Sequence
  derived and/or modified CDS sequence (wt) from DENV-2__FJ639832__SS-prME
ucugcaggcaugaucauuaugcugauuccaacagugauggcguuccaucuaaccacacgcaacggagaaccacacaugaucgucgguauacaggagaaagggaaaagucuucuguuuaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacucucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6698 - RNA, 9876 nt, Artificial Sequence
  derived and/or modified CDS sequence (wt) from DENV-2__FJ687434__SS-prME
ucuguaggcaugaucauuauguugauuccaacaguaauggcguuccaucuaaccacacgcaacggagaaccacacaugaucgucaguauacaagagaaaggaaaaagccuucuguuuaaaacagaggauggcgugaacaugugcacccucauggccauggaccuuggugaauugugugaagacacaaucacguacaaguguccccuucucaggcagaaugagccagaagacauagacugcuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaacccugauuuucauccuacugacagcugucgcuccuucaaugacaaugcguugcauaggaauaucaaauagagacuuuguagaaggggucucaggaggaagcuggguugacauagucuuagaacauggaagcugugugacgacaauggcaaaaaacaaaccaacauuggauuuugaacugauaaaaacggaagccaaacagccugccacccuaaggaaguacugcauagaagcaaggcuaaccaacacaacaacagaaucucgcugcccaacacaaggggaacccagccuaaaagaagagcaggauaagagguucgucugcaaacacuccaugguagacagaggauggggaaauggauguggauuauuuggaaaaggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaagccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggaugucguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacgauaguuaucagaguacaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggauccuugggaggaguguucacaucuauaggaaaagcccuccaccaagucuuuggagcaaucuauggagcugccuucagugggguuucauggacuaugaaaauccucauaggagucauuaucacauggauaggaaugaacucacgcagcaccucacugucugugucacuaguauuggugggaguugugacacuguauuugggagucauggugcaggccgauagugguugugucgugagcuggaaaaacaaagaacugaaauguggcagugggauuuucaucacagacaacgugcacacauggacagaacaauacaaguuccaaccagaauccccuucaaaacuagcuucagcuauccaaaaagcucaagaagagggaauuugugggauccgcucaguaacaagauuggagaaccuaauguggaaacaaauaacaccagaauugaaccacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaucaaaccuuucucauugauggccccgaaacagcagaaugccccaacacaaauagagcuuggaacucguuggaaguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccugugucucaacacaacuauagaccaggcuaccauacacaaauagcaggaccauggcaucuagguaagcuugagauggacuuugauuucugcgauggaaccacagugguagugacugaggacugcggaaauagaggacccuccuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcacuguuccuggaggaaaugcuuaggacccgaguaggaacgaaacaugcgauacuacuaguugcaguuucuuuugugacauugaucacagggaacauguccuuuaaagaucuaggaagaguggugguuaugguaggcgccaccaugacggaugacauagguaugggcguaacuuaucuugcccuacuagcagccuucaaagucagaccaacuuuugcagcaggacuacucuugagaaagcugaccuccaaggaauugaugaugacuaccauaggaauuguacuccucucccagagcacuauaccagaaaccauccuugaauugacugaugcguuagccuuaggcaugaugguccucaaaaugguaagagacauggaaaaguaucaauuagcagugacuaucauggcuaucuugugcgucccaaaugcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucugacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcggagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacagcagcagcaugguaccugugggaagugaagaaacaacgggccggaguauugugggauguuccuucacccccacccaugggaaaggcugaacuggaagauggagccuacagaaucaagcaaagagggauucuuggauauucccagaucggagcuggaguuuauaaagaaggaacauuccauacgauguggcaugucacacguggcgcuguccuaaugcauaaaggaaagaggauugaaccaucaugggcggacguuaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucccuggacuuuuccccuggaacgucaggaucuccaaucauugacaaaaaaggaaaaguugugggucuuuaugguaaugguguuguuacaaggaguggagcauacgugagugccauagcccaaacugaaaaaagcauugaagacaacccagacaucgaagacgacauuuuccgaaagagaagacugaccaucauggaccuccacccaggagcgggaaagacgaaaagauaccuuccggccauagucagagaagcuauaaaacgggguuugagaacauuaaucuuggcccccaccagaguuguggcagcugaaauggaggaagcucucagaggacucccaauaagauaccaaaccccagccaucagagcugagcacacagggcgggaaauuguggauuuaaugugucaugccacauuuaccaugagguugcuaucaccaguuagagugccaaacuacaaccugauuaucauggaugaagcccauuucacagacccagcaaguauagcagcuagaggauauaucucaacucgaguggagaugggugaagcagcugggauuuucaugacagccacucccccgggaagcagagauccauuuccucagagcaaugcaccaaucauagaugaagaaagagaaaucccugaacguucauggaauucuggacaugagugggucacggauuuuaaagggaaaacuguuugguuuguuccaagcauaaaagcaggaaaugacauagcagcuugccugagaaagaauggaaagaaaguaauacaacuuagcaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacucacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggacgccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaauuacagaaauggguaggcuuccaacguucaugacccagaagacaagagacgcacuggacaacuuagcagugcugcacacggccgaagcagguggaagggcguacaaucaugcucucagugaacugccggagacccuggagacacugcuuuuacugacacuucuggccacagucacgggagggaucuuuuuauucuugaugagcgggaggggcauagggaagaugacccuaggaaugugcugcauagucacggcuagcauccuccuaugguacgcacaaauacagccgcacuggauagcagcuucaauaauacuggaguuuuuucucauaguuuugcucauuccagaaccagaaaaacagagaacaccccaagacaaccaauugaccuauguugucauagcuauccucacagugguggccgcaaccauggcaaacgagaugggcuuccuagaaaagacgaagaaagaucuuggauuaggaagcauugcaacccagcagcccgagagcaacauccuggacauagaucuacgccccgcaucagcauggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggagcuccccuucucgccauuggaugcuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaagcaaugcucuuaguccucugcgugacucaaguauugaugaugaggacuacaugggcucugugugaggcccuaaccuuagcuaccgggcccaucuccacacugugggaaggaaauccaggaagguucuggaacacuaccauugcggugucaauggcuaacaucuuuagagggaguuacuuagcuggagcuggacuucucuuuuccauuaugaagaacacaaccaacucaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcauuaaaagaggagaaacggaccaucacgcugugucgcgaggcucagcaaaacugagaugguucguugagagaaauauggucacaccagaagggaaaguaguggaccucgguuguggcagaggaggcuggucauauuacuguggaggacuaaaaaacguaagagaagugaaaggccuaacaaaaggaggaccaggacacgaagaacccaucccuaugucaacauauggguggaaucuagugcgucuucaaaguggaguugacguuuucuucaucccgccagaaaagugugacacauuguugugugacauaggggagucaucaccaaauccuacaguggaagcaggacgaacacucagaguccuuaauuugguagaaaauugguugaacaacaacacucaauuuugcauaaaaguucuuaacccauacaugcccucaguuauagaaaaaauggaaacacugcaaaggaaauauggaggagccuuagugagaaauccacucucacggaacuccacacaugagauguacuggguuuccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauauaaaacaugggcauaccauggcagcuaugaaacaaaacagacuggaucagcaucauccauggucaauggaguggucaggcuguugacaaaaccuugggacguccuccccaccgugacacagauggcaaugacagacacgacuccauuuggacaacagcguguuuuuaaagaaaaaguggacacgagaacucaagaaccgaaagaaggcacgaagaaacuaaugaaaaucacagcagaguggcuguggaaggaauuagggaagaaaaagacaccuaggaugugcaccagagaagaauuuacaagaaaggugagaagcaaugcagcccugggggccauauucacugaugagaacaaguggaagucggcacgugaggcuguugaagauagcagguuuugggagcugguugacaaggaaaggaaucuccaucuugaaggaaagugugaaacauguguguacaacaugaugggaaaaagagaaaagaaacuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucugagagacgugagcaagaaagagggaggagccauguaugccgaugacacagcaggaugggacacaagaauuacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggaguuuuuaaaaacauucagcaccugacagucacagaagagaucgccgugcagaacugguuagcaagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugcccuucuguucacaccauuuccaugaacuaaucaugaaggauggucguguacuuguuguuccaugcagaaaccaagaugaacugauuggcagagcccgaaucucccaaggagcagggugguccuugcgggagacggccuguuuggggaagucuuacgcccaaauguggagcuugauguauuuccacagacgcgaccucagguuggcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccuguagaaucaugggaggaaaucccguacuuggggaaaagagaagaucaauggugcggcucauugauuggguuaacaagcagggccacaugggcaaagaacauccaagcagcaauaaaucaaguuagaucucuuauaggcaaugaggaauacacagacuacaugccauccaugaaaagauucagaagagaagaggaagaagcaggaguccugugguag

SEQ ID NO: 6699 - RNA, 9876 nt, Artificial Sequence
  derived and/or modified CDS sequence (wt) from DENV-2__FJ687439__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauucugagacauccaggcuucaccauaauggcagcaauccuggcauacaccauagggacgacacauuuccagagagcccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacaauagucaucagagugcaauaugaaggggacggcucuccauguaaaaucccuuuugagauaauggauuuggaaaaaagauaugucuuaggccgccugaucacagucaacccaauugcaacagaaaaagauagcccagucaacauagaagcagaaccuccauucggagacagcuacaucaucauaggaguagagccgggacaacugaagcucaacugguucaagaaaggaaguucuaucggccaaauguuugagacgacgaugagaggggcgaagagaauggccauuuugggugacacagccugggacuucggaucccuggggggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguacuggugggaauugugacacuguacuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugcgggauccgcucgguaacaagauuggagaaccuaauguggaaacaaauaacaccagaauugaaucacauucuagcagaaaaugaggugaaguuaacuaucaugacaggagacaucaaaggaaucaugcaagcaggaaaacgaucuuugcggccucagccuacugagcuaaaguauucauggaaaacaugggguaaagcaaaaaugcucuccacagagucuuauaaccaaaccuuucucauugauggccccgagacggcagagugcccuaacacaaauagagcuuggaacucuuuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggaguccugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauaggcaugggcgugacuuaucuugcccuacuagcagccuucaaaguuagaccaacuuuugcagcuggacuacucuugagaaagcugaccuccaaggaauugaugaugaccaccauaggaauuguacuccucucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauuguuggugaucucaggacuuuucccuauaucaauaccaaucacggcagcagcaugguaccugugggaagugaagaaacaacgggccggaguauugugggacguuccuucacccccacccaugggaaaagcugaacuggaagauggagccuauagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauugucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagagggaaucauucccaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuggaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauauaucccuaacagcuauagccaaccaagcaacaguauuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacauuuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggaagaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacaaacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacguguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcuauaaaucagguuagaucucuuauaggcaaugaggaauacacagauuacaugccauccaugaaaagauuuagaagagaagaggaagaagcaggaguccugugguaa

SEQ ID NO: 6700 - RNA, 9876 nt, Artificial Sequence
  derived and/or modified CDS sequence (wt) from DENV-2__FJ687440__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggauaaccuaugggacuuguaccacuacgggagaacauagaagagaaaaaagaucaguggcacucguuccacaugugggaaugggacuggagacgcgaaccgaaaccuggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaaugugguagugggauuuucaucacagacaacguacacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccaucuuucuaacaacccucucaagaaccaacaagaaaaggagcuggccgcuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacuaaaccuggucuuuucaaaacuaacaccggaacaauaggugccguaucucuggacuuuuccccuggaacgucaggaucuccaaucauugauaaaaaaggaaaaguugugggucuuuaugguaaugguguugucacaaggaguggagcauaugugagugcuauagcccaaacugaaaaaagcauugaagacaaccccgaaaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugaguggguuacggauuuuacagggaagacuguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggauuuuuuuauucuugaugagcgggaggggcauagggaagaugacccugggaaugugcugcauaauuacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagaguggaguugacgucuucuucaucccgccagaaaagugugacacauuauugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaucaggaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauucggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucugagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaauugccgugcaaaacugguuagcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6701 - RNA, 9876 nt, Artificial Sequence
  derived and/or modified CDS sequence (wt) from DENV-2__FJ687441__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggauaaccuaugggacuuguaccacuacgggagaacauagaagagaaaaaagaucaguggcacucguuccacaugugggaaugggacuggagacgcgaaccgaaaccuggaugucaucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacagggaaacacggcaaggaaaucaaaguaacaccacagaguuccaucacagaagcugaauugacagguuauggcaccgucacgauggagugcucuccgagaacaggccucgacuucaaugagaugguguugcugcagauggaaaauaaagcuuggcuggugcauaggcaaugguuccuagaccugccauuaccguggcugcccggagcggacaaacaagggucaaauuggauacagaaagaaacauuggucacuuucaaaaauccccaugcaaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauacgaaggggacggcucuccauguaaaaucccuuuugagauaauggauuuggaaaaaagauaugucuuaggccgccuaaucacagucaacccaauuguaacagaaaaagauagcccagucaacauagaagcagaaccuccauucggagacagcuacaucaucauaggaguagagccgggacaacugaagcucaacugguucaagaaaggaaguucuauuggccaaauguuugagacaacgaugagaggggcaaagagaauggccauuuugggugacacagccugggacuucggcucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcacuucacugucugugucacuaguauuggugggaauugugacacuguauuugggagucauggugcaggccgauagugguugcguugugagcuggaaaaacaaagaacugaaaugugguagugggauuuucaucacagacaacguacacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgagacggcagaaugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuaggcaagcuugagauggacuuugauuucugcgauggaaccacagugauagugaccgaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaauucuuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccaucuuucuaacaacccucucaagaaccaacaagaaaaggagcuggccgcuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucaucagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacuaaaccuggucuuuucaaaacuaacaccggaacaauaggugccguaucucuggacuuuuccccuggaacgucaggaucuccaaucauugauaaaaaaggaaaaguugugggucuuuaugguaaugguguugucacaaggaguggagcauaugugagugcuauagcccaaacugaaaaaagcauugaagacaaccccgaaaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaagcagagauccauuuccucagagcaaugcaccaaucauagaugaagaaagagaaaucccugaacguucauggaauucuggacaugaguggguuacggauuuuaaagggaagacuguuugguucguuccaagcauaaaagcaggaaaugauauagcagcuugccugagaaaaaauggaaagaaaguaauacaacucaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggagaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggauuuuuuuauucuugaugagcgggaggggcauagggaagaugacccugggaaugugcugcauaauuacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaauccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaaugcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuccagaguggaguugacgucuucuucaucccgccagaaaagugugacacauuauugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucggugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaucaggaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauucggacaacagcguguuuuuaaagaaaaaguggacacgagaacccaagaaccgaaagaaggcacgaagaaauuaaugaaaaucacagcagaauggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucugagagacgugagcaagaaagagggaggagccauguacgccgacgacacagcaggaugggacacaagaaucacacuagaagacuuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagccacagaagaaauugccgugcaaaacugguuagcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaauggugcggcucauugauugggcuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguaa

SEQ ID NO: 6702 - RNA, 9876 nt, Artificial Sequence
  derived and/or modified CDS sequence (wt) from DENV-2__FJ687445__SS-prME
ucuguaggcaugaucauuaugcugauuccaacaguaauggcguuccaucuaaccacacgcaacggagaaccacacaugaucgucaguauacaagagaaaggaaaaagccuucuguuuaaaacagaggauggcgugaacaugugcacccucauggccauggaccuuggugaauugugugaagacacaaucacguacaaguguccccuucucaggcagaaugagccagaagacauagacugcuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaacccugauuuucauccuacugacagcugucgcuccuucaaugacaaugcguugcauaggaauaucaaauagagacuuuguagaaggggucucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucgcugcccaacacaaggggaacccagccuaaaagaagagcaggauaagagguucgucugcaaacacuccaugguagacagaggauggggaaauggauguggauuauuuggaaaaggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggaugucguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacgauaguuaucagaguacaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggauccuugggaggaguguuuacaucuauaggaaaagcccuccaccaagucuuuggagcaaucuauggagcugccuucagugggguuucauggacuaugaaaauccucauaggagucauuaucacauggauaggaaugaacucacgcagcaccucacugucugugucacuaguauuggugggaguugugacacuguauuugggagucauggugcaggccgauagugguugcgucgugagcuggaaaaacaaagaacugaaauguggcagugggauuuucaucacagacaacgugcacacauggacagaacaauacaaguuccaaccagaauccccuucaaaacuagcuucagccauccaaaaagcucaagaagagggaauuugugggauccgcucaguaacaagauuggagaaccuaauguggaaacaaauaacaccagaauugaaucacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaucaaaccuuucucauugauggccccgagacagcagaaugccccaacacaaauagagcuuggaacucguuggaaguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaggccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcacuguuccuggaggaaaugcuuaggacccgaguaggaacgaaacaugcgauacuacuaguugcaguuucuuuugugacauugaucacagggaacauguccuuuaaagaucuaggaagaguggugguuaugguaggcgccaccaugacggaugacauagguaugggcguaacuuaucuugcccuacuagcagccuucaaagucagaccaacuuuugcagcaggacuauucuugagaaagcugaccuccaaggaauugaugaugacuaccauaggaauuguacuccucucccagagcacuauaccagaaaccauccuugaauugacugaugcguuagccuuaggcaugaugguccucaaaaugguaagagacauggaaaaguaucaauuagcagugaccaucauggcuaucuugugcgucccaaaugcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucugacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacagcagcagcaugguaccugugggaagugaagaaacaacgggccggaguauugugggauguuccuucacccccacccaugggaaaggcugaacuggaagauggagccuacagaaucaagcaaagagggauucuuggauauucccagaucggagcuggaguuuauaaagaaggaacauuccauacgauguggcaugucacacguggcgcuguccuaacgcauaaaggaaagaggauugaaccaucaugggcggacguuaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauacgugagugccauagcccaaacugaaaaaagcauugaagacaacccagacaucgaagacgacauuuuccgaaagagaagacugaccaucauggaccuccacccaggagcgggaaagacgaaaagauaccuuccggccauagucagagaagcuauaaaacgggguuugagaacauuaaucuuggcccccaccagaguuguggcagcugaaauggaggaagcucucagaggacucccaauaagauaccaaaccccagccaucagagcugagcacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccaaucauagaugaagaaagagaaaucccugaacguucauggaauucuggacaugagugggucacggauuuuaaagggaaaacuguuugguuuguuccaagcauaaaagcaggaaaugauauagcagccugccugagaaagaauggaaagaaaguaauacaacuuagcaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacucacucuagugcagcacaaagaagagggagaauaggaagaaauccaaaaaaugaaaaugaucaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggacgccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaaccccgaugguuggaugcuaggaucuacucugacccacuggcgcuaaaagaauucaaagaauuugcagccggaagaaagucucugacccugaaccuaauuacagaaauggguaggcuuccaacguucaugacccagaagacaagagacgcacuggauaacuuagcagugcugcacacggccgaagcagguggaagggcguacaaucaugcucucagugaacugccggagacccuggagacacugcuuuuacugacacuucuggccacagucacgggagggaucuuuuuauucuugaugagcgggaggggcauagggaagaugacccuaggaaugugcugcauagucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaagacgaagaaagaucuuggauuaggaagcauugcaacccagcagcccgagagcaacauccuggacauagaucuacgccccgcaucagcauggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggagcuccccuucucgccauuggaugcuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccucaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacucaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcauuaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgccuucaaaguggaguugacguuuucuucaucccgccagaaaagugugacacauuguugugugacauaggggagucaucaccaaauccuacaguggaagcaggacgaacacucagaguccuuaauuugguagaaaauugguugaacaacaacacucaauuuugcauaaaaguucuuaacccauacaugcccucaguuauagaaaaaauggaaacacugcaaaggaaauauggaggagccuuagugagaaauccacucucacggaacuccacacaugagauguacuggguuuccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauauaaaacaugggcauaccauggcagcuaugaaacaaaacagacuggaucagcaucauccauggucaauggaguggucaggcuguugacaaaaccuugggacguccuccccaccgugacacagauggcaaugacagacacgacuccauuuggacaacagcguguuuuuaaagaaaaaguggacacgagaacucaagaaccgaaagaaggcacgaagaaacuaaugaaaaucacagcagaguggcuguggaaggaauuagggaagaaaaagacaccuaggaugugcaccagagaagaauuuacaagaaaggugagaagcaaugcagccuugggggccauauucacugaugagaauaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaggcuagguuacauucugagagacgugagcaagaaagagggaggagccauguaugccgaugacacagcaggaugggacacaagaauuacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggaguuuuuaaaaacauucagcaccugacagucacagaagaaaucgccgugcagaacugguuagcaagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugcccuucuguucacaccauuuccaugaacuaaucaugaaggauggucguguacuuguuguuccaugcagaaaccaagaugaacugauuggcagagcccgaaucucccaaggagcagggugguccuugcgggagacggccuguuuggggaagucuuacgcccaaauguggagcuugauguauuuccacagacgcgaccucagguuagcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguagaaucaugggaggaaaucccguacuuggggaaaagagaagaucaauggugcggcucauugauuggguuaacaagcagggccacaugggcaaagaacauccaaguagcaauaaaucaaguuagaucucuuauaggcaaugaggaauacacagacuacaugccauccaugaaaagauucagaagagaagaggaagaagcaggaguccugugguag

SEQ ID NO: 6703 - RNA, 9876 nt, Artificial Sequence
  derived and/or modified CDS sequence (wt) from DENV-2__FJ687447__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacgugggugaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaauaaaccaacauuggauuucgaauugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaagccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucaccuucaaaaauccccaugcgaagaaacaggauguuguuguuuuaggaucccaagaaggggccaugcauacagcacucacaggagccacagaaauccaaaugucgucaggaaacuugcucuucacugggcaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaaguuuuuggagcaaucuauggagcugccuucagugguguuucauggacuaugaaaauccucauaggagucauuaucacauggauaggaaugaacucacgcagcaccucacugucugugucacuaguacuggugggaauugugacacuguauuugggagucauggugcaggccgauagcgguugcguugugagcuggaaaaacaaagaacugaaauguggcagugggauuuucaucacagacaacgugcacacauggacagaacaauacaaguuccaaccagaauccccuucaaaacuagcuucagcuauccaaaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccccagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuucgauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacauggacagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaccaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggcagacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccauaggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugagacugcuaucaccaguuagagugccaaacuacaacuugauuaucauggacgaagcccauuucacagacccagcaaguauagcagcuagaggauacaucucaacccgaguugagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauucccaguauguuugaaccagagcgugaaaaaguggaugccauugauggcgaauaccguuugagaggagaagcaaggaaaaccuuuguggacuuaaugaggagaggagacuuaccagucugguuggcuuucaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuagaugcuaggaucuacucugacccacuggcguuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacugcuggcuacagucacaggagggaucuuucuauuuuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugccucugggaacauagugucaucagugaacaugauuucaaggauguugaucaacagauucacaaugagacacaagaaagccacuuaugagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaagacgugggcauaccaugguagcuacgaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguuuuccagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaguggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6704 - RNA, 9876 nt, Artificial Sequence
  derived and/or modified CDS sequence (wt) from DENV-2__FJ810411__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacgugggugaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaauaaaccaacauuggauuucgaauugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaagccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucaccuucaaaaauccccaugcgaagaaacaggauguuguuguuuuaggaucccaagaaggggccaugcauacagcacucacaggagccacagaaauccaaaugucgucaggaaacuugcucuucacugggcaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaaguuuuuggagcaaucuauggagcugccuucagugguguuucauggacuaugaaaauccucauaggagucauuaucacauggauaggaaugaacucacgcagcaccucacugucugugucacuaguacuggugggaauugugacacuguauuugggagucauggugcaggccgauagcgguugcguugugagcuggaaaaacaaagaacugaaauguggcagugggauuuucaucacagacaacgugcacacauggacagaacaauacaaguuccaaccagaauccccuucaaaacuagcuucagcuauccaaaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccccagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacauggacagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaccaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggcagacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccauaggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugagacugcuaucaccaguuagagugccaaacuacaacuugauuaucauggacgaagcccauuucacagacccagcaaguauagcagcuagaggauacaucucaacccgaguugagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauucccaguauguuugaaccagagcgugaaaaaguggaugccauugauggcgaauaccguuugagaggagaagcaaggaaaaccuuuguggacuuaaugaggagaggagacuuaccagucugguuggcuuucaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuagaugcuaggaucuacucugacccacuggcguuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacugcuagcuacagucacaggagggaucuuucuauuuuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugccucugggaacauagugucaucagugaacaugauuucaaggauguugaucaacagauucacaaugagacacaagaaagccacuuaugagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaagacgugggcauaccaugguagcuacgaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaauggcuguggaaagaacuagggaagaaaaagacaccuaggaugugcaccagagaagaauucacaaaaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguuuuccagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaguggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6705 - RNA, 9876 nt, Artificial Sequence
  derived and/or modified CDS sequence (wt) from DENV-2__FJ744713__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacgugggugaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaauaaaccaacauuggauuucgaauugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaagccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucaccuucaaaaauccccaugcgaagaaacaggauguuguuguuuuaggaucccaagaaggggccaugcauacagcacucacaggagccacagaaauccaaaugucgucaggaaacuugcucuucacugggcaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaaguuuuuggagcaaucuauggagcugccuucagugguguuucauggacuaugaaaauccucauaggagucauuaucacauggauaggaaugaacucacgcagcaccucacugucugugucacuaguacuggugggaauugugacacuguauuugggagucauggugcaggccgauagcgguugcguugugagcuggaaaaacaaagaacugaaauguggcagugggauuuucaucacagacaacgugcacacauggacagaacaauacaaguuccaaccagaauccccuucaaaacuagcuucagcuauccaaaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccccagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacauggacagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaccaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggcagacuuggaacuggagagagcaaccgaugucaaaugggaagaccaggcagagauaucaggaagcaguccaauccugucaauaacaauaucagaagaugguagcaugucgauaaaaaaugaagaggaagaacaaauacugaccauacucauuagaacaggauugcuggugaucucaggacuuuuuccuauaucaauaccaaucacggcagcagcaugguaccugugggaagugaagaaacaacgggccggaguauugugggacguuccuucacccccacccauaggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagcuauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugagacugcuaucaccaguuagagugccaaacuacaacuugauuaucauggacgaagcccauuucacagacccagcaaguauagcagcuagaggauacaucucaacccgaguugagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaauacaccagaaggaaucauucccaguauguuugaaccagagcgugaaaaaguggaugccauugauggcgaauaccguuugagaggagaagcaaggaaaaccuuuguggacuuaaugaggagaggagacuuaccagucugguuggcuuucaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuagaugcuaggaucuacucugacccacuggcguuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacugcuggcuacagucacaggagggaucuuucuauuuuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacaccaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugccucugggaacauagugucaucagugaacaugauuucaaggauguugaucaacagauucacaaugagacacaagaaagccacuuaugagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaagacgugggcauaccaugguagcuacgaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguuuuccagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauacuugggaaaaagagaagaccaguggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6706 - RNA, 9876 nt, Artificial Sequence
  derived and/or modified CDS sequence (wt) from DENV-2__FJ744714__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaaaggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6707 - RNA, 9876 nt, Artificial Sequence
  derived and/or modified CDS sequence (wt) from DENV-2__FJ744716__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacacgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaaaggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcgcacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuauaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugaucucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaaugcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6708 - RNA, 9876 nt, Artificial Sequence
  derived and/or modified CDS sequence (wt) from DENV-2__FJ744718__SS-prME
ucugcaggcaugaucauuauguugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggacaagagguucgucugcaaacacuccaugguagacagaggauggggaaauggauguggauuauuuggaaaggggggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggucgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggauuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagauaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucuuauaaccaaaccuuucucauugauggccccgagacggcagagugcccuaacacaaauagagcuuggaauucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuacagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaaacugaccuccaaggaauugaugaugacuaccauaggaauuguacuccucucccaaagcacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggccuagggaaaggauggccauugucaaagauggacaucggaguuccccuucucgccauuggauguuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaguccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaacuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgagaaaacccauggauggaagacaaaaccccaguggaaucaugggaggaaaucccauaccugggaaaaagagaagaccaauggugcggcucauugauuggguuaacaagcagggccacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6709 - RNA, 9876 nt, Artificial Sequence
  derived and/or modified CDS sequence (wt) from DENV-2__FJ744722__SS-prME
ucuguaggcaugaucauuaugcugauuccaacaguaauggcguuccaucuaaccacacgcaacggagaaccacacaugaucgucaguauacaagagaaaggaaaaagccuucuguuuaaaacagaggauggcgugaacaugugcacccucauggccauggaccuuggugaauugugugaagacacaaucacguacaaguguccccuucucaggcagaaugagccagaagacauagacugcuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaacccugauuuucauccuacugacagcugucgcuccuucaaugacaaugcguugcauaggaauaucaaauagagacuuuguagaaggggucucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucgcugcccaacacaaggggaacccaaccuaaaagaagagcaggauaagagguucgucugcaaacacuccaugguagacagaggauggggaaauggauguggauuauuuggaaaaggaggcauugugaccugugcuauguucacaugcaaaaagaacauggaagggaaaaucgugcaaccagaaaacuuggaauacaccauugugguaacaccccacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccuaccauuaccauggcugcccggagcggauacacaagggucaaauuggauacagaaagaaacauuggucacuuucaaaaauccccaugcgaagaaacaggaugucguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacgauaguuaucagaguacaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggauccuugggaggaguguuuacaucuauaggaaaagcccuccaccaagucuuuggagcaaucuauggagcugccuucagugggguuucauggacuaugaaaauccucauaggagucauuaucacauggauaggaaugaacucacgcagcaccucacugucugugucacuaguauugguggggguugugacacuguauuugggagucauggugcaggccgauagugguugcgucgugagcuggaaaaacaaagaacugaaauguggcagugggauuuucaucacagacaacgugcacacauggacagaacaauacaaguuccaaccagaauccccuucaaaacuagcuucagccauccaaaaagcucaagaagagggaauuugugggauccgcucaguaacaagauuggagaaccuaauguggaaacaaauaacaccagaauugaaucacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaucaaaccuuucucauugauggccccgagacagcagaaugccccaacacaaauagagcuuggaacucguuggaaguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaggccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcacuguuccuggaggaaaugcuuaggacccgaguaggaacgaaacaugcgauacuacuaguugcaguuucuuuugugacauugaucacagggaacauguccuuuaaagaucuaggaagaguggugguuaugguaggcgccaccaugacggaugacauagguaugggcguaacuuaucuugcccuacuagcagccuucaaagucagaccaacuuuugcagcaggacuauucuugagaaagcugaccuccaaggaauugaugaugacuaccauaggaauuguacuccucucccagagcacuauaccagaaaccauccuugaauugacugaugcguuagccuuaggcaugaugguccucaaaaugguaagagacauggaaaaguaucaauuagcagugaccaucauggcuaucuugugcgucccaaaugcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucugacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacagcagcagcaugguaccugugggaagugaagaaacaacgggccggaguauugugggauguuccuucacccccacccaugggaaaggcugaacuggaagauggagccuacagaaucaagcaaagagggauucuuggauauucccagaucggagcuggaguuuauaaagaaggaacauuccauacgauguggcaugucacacguggcgcuguccuaacgcauaaaggaaagaggauugaaccaucaugggcggacguuaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauacgugagugccauagcccaaacugaaaaaagcauugaagacaacccagacaucgaagacgacauuuuccgaaagagaagacugaccaucauggaccuccacccaggagcgggaaagacgaaaagauaccuuccggccauagucagagaagcuauaaaacgggguuugagaacauuaaucuuggcccccaccagaguuguggcagcugaaauggaggaagcucucagaggacucccaauaagauaccaaaccccagccaucagagcugagcacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccaaucauagaugaagaaagagaaaucccugaacguucauggaauucuggacaugagugggucacggauuuuaaagggaaaacuguuugguuuguuccaagcauaaaagcaggaaaugauauagcagccugccugagaaagaauggaaagaaaguaauacaacuuagcaggaagacuuuugauucugaguaugucaagacuagaaccaaugauugggauuucgugguuacaacugacauuucagaaaugggagccaauuucaaggcugagaggguuauagaccccagacgcugcaugaaaccagucauacuaacagauggugaggagcgggugauucuggcaggaccuaugccagugacucacucuagugcagcacaaagaagagggagaauaggaagaaauccaaaaaaugaaaaugaucaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggacgccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaaccccgaugguuggaugcuaggaucuacucugacccacuggcgcuaaaagaauucaaagaauuugcagccggaagaaagucucugacccugaaccuaauuacagaaauggguaggcuuccaacguucaugacccagaagacaagagacgcacuggauaacuuagcagugcugcacacggccgaagcagguggaagggcguacaaucaugcucucagugaacugccggagacccuggagacacugcuuuuacugacacuucuggccacagucacgggagggaucuuuuuauucuugaugagcgggaggggcauagggaagaugacccuaggaaugugcugcauagucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaagacgaagaaagaucuuggauuaggaagcauugcaacccagcagcccgagagcaacauccuggacauagaucugcgccccgcaucagcauggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggagcuccccuucucgccauuggaugcuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacucaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcauuaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgccuucaaaguggaguugacguuuucuucaucccgccagaaaagugugacacauuguugugugacauaggggagucaucaccaaauccuacaguggaagcaggacgaacacucagaguccuuaauuugguagaaaauugguugaacaacaacacucaauuuugcauaaaaguucuuaacccauacaugcccucaguuauagaaaaaauggaaacacugcaaaggaaauauggaggagccuuagugagaaauccacucucacggaacuccacacaugagauguacuggguuuccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacaugggcauaccauggcagcuaugaaacaaaacagacuggaucagcaucauccauggucaauggaguggucaggcuguugacaaaaccuugggacguccuccccaccgugacacagauggcaaugacagacacgacuccauuuggacaacagcguguuuuuaaagaaaaaguggacacgagaacucaagaaccgaaagaaggcacgaagaaacuaaugaaaaucacagcagaguggcuguggaaggaauuagggaagaaaaagacaccuaggaugugcaccagagaagaauuuacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaggcuagguuacauucugagagacgugagcaagaaagagggaggagccauguaugccgaugacacagcaggaugggacacaagaauuacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggaguuuuuaaaaacauucagcaccugacagucacagaagaaaucgccgugcagaacugguuagcaagaguggggcgcgaaagguuaucaagaauggccaucaguggagaugauuguguugugaaaccuuuagaugacagguucgcgagugcuuugacagcucuaaaugacaugggaaagauuagaaaagacauacaacaaugggaaccuucaagaggauggaacgauuggacacaagugcccuucuguucacaccauuuccaugaacuaaucaugaaggauggucguguacuuguuguuccaugcagaaaccaagaugaacugauuggcagagcccgaaucucccaaggagcagggugguccuugcgggagacggccuguuuggggaagucuuacgcccaaauguggagcuugauguauuuccacagacgcgaccucagguuagcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguagaaucaugggaggaaaucccguacuuggggaaaagagaagaucaauggugcggcucauugauuggguuaacaagcagggccacaugggcaaagaacauccaaguagcaauaaaucaaguuagaucucuuauaggcaaugaggaauacacagacuacaugccauccaugaaaagauucagaagagaagaggaagaagcaggaguccugugguag

SEQ ID NO: 6710 - RNA, 9876 nt, Artificial Sequence
  derived and/or modified CDS sequence (wt) from DENV-2__FJ744723__SS-prME
ucuguaggcaugaucauuaugcugauuccaacaguaauggcguuccaucuaaccacacgcaacggagaaccacacaugaucgucaguauacaagagaaaggaaaaagccuucuguuuaaaacagaggauggcgugaacaugugcacccucauggccauggaccuuggugaauugugugaagacacaaucacguacaaguguccccuucucaggcagaaugagccagaagacauagacugcuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaacccugauuuucauccuacugacagcugucgcuccuucaaugacaaugcguugcauaggaauaucaaauagagacuuuguagaaggggucucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucgcugcccaacacaaggggaacccagccuaaaagaagagcaggauaagagguucgucugcaaacacuccaugguagacagaggauggggaaauggauguggauuauuuggaaaaggaggcauugugaccugugcuauguucacaugcaaaaagaacauggaagggaaaaucgugcaaccagaaaacuuggaauacaccauugugguaacaccccacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccuaccauuaccauggcugcccggagcggauacacaagggucaaauuggauacagaaagaaacauuggucacuuucaaaaauccccaugcgaagaaacaggaugucguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacgauaguuaucagaguacaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggauccuugggaggaguguuuacaucuauaggaaaagcccuccaccaagucuuuggagcaaucuauggagcugccuucagugggguuucauggacuaugaaaauccucauaggagucauuaucacauggauaggaaugaacucacgcagcaccucacugucugugucacuaguauuggugggaguugugacacuguauuugggagucauggugcaggccgauagugguugcgucgugagcuggaaaaacaaagaacugaaauguggcagugggauuuucaucacagacaacgugcacacauggacagaacaauacaaguuccaaccagaauccccuucaaaacuagcuucagccauccaaaaagcucaagaagagggaauuugugggauccgcucaguaacaagauuggagaaccuaauguggaaacaaauaacaccagaauugaaucacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaucaaaccuuucucauugauggccccgagacagcagaaugccccaacacaaauagagcuuggaacucguuggaaguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaggccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacuaggagucuugggaauggcacuguuccuggaggaaaugcuuaggacccgaguaggaacgaaacaugcgauacuacuaguugcaguuucuuuugugacauugaucacagggaacauguccuuuaaagaucuaggaagaguggugguuaugguaggcgccaccaugacggaugacauagguaugggcguaacuuaucuugcccuacuagcagccuucaaagucagaccaacuuuugcagcaggacuauucuugagaaagcugaccuccaaggaauugaugaugacuaccauaggaauuguacuccucucccagagcacuauaccagaaaccauccuugaauugacugaugcguuagccuuaggcaugaugguccucaaaaugguaagagacauggaaaaguaucaauuagcagugaccaucauggcuaucuugugcgucccaaaugcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucugacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacagcagcagcaugguaccugugggaagugaagaaacaacgggccggaguauugugggauguuccuucacccccacccaugggaaaggcugaacuggaagauggagccuacagaaucaagcaaagagggauucuuggauauucccagaucggagcuggaguuuauaaagaaggaacauuccauacgauguggcaugucacacguggcgcuguccuaacgcauaaaggaaagaggauugaaccaucaugggcggacguuaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauacgugagugccauagcccaaacugaaaaaagcauugaagacaacccagacaucgaagacgacauuuuccgaaagagaagacugaccaucauggaccuccacccaggagcgggaaagacgaaaagauaccuuccggccauagucagagaagcuauaaaacgggguuugagaacauuaaucuuggcccccaccagaguuguggcagcugaaauggaggaagcucucagaggacucccaauaagauaccaaaccccagccaucagagcugagcacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccaaucauagaugaagaaagagaaaucccugaacguucauggaauucuggacaugagugggucacggauuuuaaagggaaaacuguuugguuuguuccaagcauaaaagcaggaaaugauauagcagccugccugagaaagaauggaaagaaaguaauacaacuuagcaggaagacuuuugauucugaguaugucaagacuagaaccaaugauugggauuucgugguuacaacugacauuucagaaaugggagccaauuucaaggcugagaggguuauagaccccagacgcugcaugaaaccagucauacuaacagauggugaggagcgggugauucuggcaggaccuaugccagugacucacucuagugcagcacaaagaagagggagaauaggaagaaauccaaaaaaugaaaaugaucaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggacgccauugauggcgaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaaccccgaugguuggaugcuaggaucuacucugacccacuggcgcuaaaagaauucaaagaauuugcagccggaagaaagucucugacccugaaccuaauuacagaaauggguaggcuuccaacguucaugacccagaagacaagagacgcacuggauaacuuagcagugcugcacacggccgaagcagguggaagggcguacaaucaugcucucagugaacugccggagacccuggagacacugcuuuuacugacacuucuggccacagucacgggagggaucuuuuuauucuugaugagcgggaggggcauagggaagaugacccuaggaaugugcugcauagucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuauguugucauagccauccucacagugguggccgcaaccauggcaaacgagauggguuuccuagaaaagacgaagaaagaucuuggauuaggaagcauugcaacccagcagcccgagagcaacauccuggacauagaucugcgccccgcaucagcauggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggagcuccccuucucgccauuggaugcuacucacaagucaaucccauaacucucacagcagcucuucucuuauugguagcgcauuaugccauuauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacucaagaaggggaacuggcaacauaggagagacgcuuggagagaaauggaaaagccgauugaacgcacugggaaaaagugaauuccagaucuacaagaaaaguggaauccaggagguggauagaaccuuagcaaaagaaggcauuaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgccuucaaaguggaguugacguuuucuucaucccgccagaaaagugugacacauuguugugugacauaggggagucaucaccaaauccuacaguggaagcaggacgaacacucagaguccuuaauuugguagaaaauugguugaacaacaacacucaauuuugcauaaaaguucuuaacccauacaugcccucaguuauagaaaaaauggaaacacugcaaaggaaauauggaggagccuuagugagaaauccacucucacggaacuccacacaugagauguacuggguuuccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacaugggcauaccauggcagcuaugaaacaaaacagacuggaucagcaucauccauggucaauggaguggucaggcuguugacaaaaccuugggacguccuccccaccgugacacagauggcaaugacagacacgacuccauuuggacaacagcguguuuuuaaagaaaaaguggacacgagaacucaagaaccgaaagaaggcacgaagaaacuaaugaaaaucacagcagaguggcuguggaaggaauuagggaagaaaaagacaccuaggaugugcaccagagaagaauuuacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaggcuagguuacauucugagagacgugagcaagaaagagggaggagccauguaugccgaugacacagcaggaugggacacaagaauuacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaacacuuucaccaauauggaagcccaauuaaucagacagauggagggagaaggaguuuuuaaaaacauucagcaccugacagucacagaagaaaccgccgugcagaacugguuagcaagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugcccuucuguucacaccauuuccaugaacuaaucaugaaggauggucguguacuuguuguuccaugcagaaaccaagaugaacugauuggcagagcccgaaucucccaaggagcagggugguccuugcgggagacggccuguuuggggaagucuuacgcccaaauguggagcuugauguauuuccacagacgcgaccucagguuagcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguagaaucaugggaggaaaucccguacuuggggaaaagagaagaucaauggugcggcucauugauuggguuaacaagcagggccacaugggcaaagaacauccaaguagcaauaaaucaaguuagaucucuuauaggcaaugaggaauacacagacuacaugccauccaugaaaagauucagaagagaagaggaagaagcaggaguccugugguag

SEQ ID NO: 6711 - RNA, 9876 nt, Artificial Sequence
  derived and/or modified CDS sequence (wt) from DENV-2__FJ744724__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccauaguagacagaggguggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccgucacagaagcagaauugacagguuauggcaccgucacgauggagugcucuccgagaacaggccucgauuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucucugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacauggggcaaagcaaaaaugcucuccacagagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagcuucuuucauugaaguaaaaaacugccacuggccaaagucacacacccucuggaguaauggagugcuagaaagcgagaugauaauuccaaagaaucucgcuggaccagugucucaacacaacuauagaccaggcuaccauacacaaauagcaggaccauggcaucuagguaagcuugagauggacuuugacuucugcgauggaaccacagugguagugacugaggacugcggaaauagaggacccucuuuaagaacaacuacugcuucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagauugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuaccauggcggaugacauagguaugggcgugacuuaucuugcccuacuagcagcuuucaaaguuagaccaacuuuugcagcuggacuacucuugagaaagcugaccuccaaggaauugaugaugacuaccauaggaauuguacuccucucccaaagcacuauaccagagaccguucuugaauugacugaugcguuagccuuaggcaugaugguccuuaaaauaguaagagacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaagugauacaacuuaguaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacccacucuagugcagcgcaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccguuugagaggagaagcaaggaaaaccuuuguggacuuaaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaucuacgucccgcaucagcauggacgcuguaugccguggcuacaacauucguuacaccaaugcugagacauagcauugagaauuccucagugaauguaucccuaacagccauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccauuauagggccaggacuucaagcaaaagcaaccagagaagcucagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacgucuucuucaucccgccagaaaagugugacacauugcugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauuuacaaugagacacaagaaagccacuuacgagccggauguugaccucggaagcggaacccguaacauuggaauugaaagugaaguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcccgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccacauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacaugcugacagucuggaacaggguguggauucgggaaaacccauggauggaagacaaaaccccaguggaaucaugggaggaaaucccauacuuggggaaaagagaagaucaaugguguggcucacugauuggguuaacaagcagggccacaugggcaaagaacauucaaacagcaauaaaucaaguuagaucucuuauaggcaaugaggaauacacagauuacaugccauccaugaaaagauucagaagagaagaggaagaagcaggaguccugugguag

SEQ ID NO: 6712 - RNA, 9876 nt, Artificial Sequence
  derived and/or modified CDS sequence (wt) from DENV-2__FJ906957__SS-prME
ucugcaggcaugaucauuaugcugauuccaacagugauggcguuccaucuaaccacacguaacggagaaccacacaugaucgucaguauacaggagaaagggaaaagucuucuguuuaaaacagaggauggcgugaacaugugcacccucauggcuauggaccuuggugaauugugugaagacacaaucacguacaagugcccucuucucaggcagaaugagccagaagacauagacuguuggugcaacuccacguccacguggguaaccuaugggacuuguaccacuacgggagaacauagaagagaaaaaagaucaguggcacucguuccacaugugggaaugggacuggagacgcgaaccgaaacauggaugucaucagaaggggcuuggaaacacgcccagagaauugaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauaaacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucucuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucucuacggccucagcccaccgagcuaaaguauucauggaaaacaugggguaaagcaaaaaugcucuccacagagucucauaaccaaaccuuucucauugauggccccgaaacggcagagugccccaacacaaauagagcuuggaauucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuugagaacaacuacugccucuggaaaacucauaacagaauggugcugccgaucuugcacauuaccaccccuaagauacagaggugaggaugggugcugguacgggauggaaauuagaccauugaaagagaaagaagaaaauuugguuaacuccuuggucacagccggacaugggcagguugacaauuuuucacugggagucuugggaauggcauuguuccuggaggaaaugcuuaggacccgagucggaacgaaacaugcaauacuacuaguugcagcuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccuuucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacugguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuauaaagaaggaacauuccauacaauguggcaugucacacguggcgcuguccuaaugcauaaaggaaagaggauugaaccuucaugggcggacgucaaaaaagaucuaauaucauauggaggaggcuggaaguuagaaggagaauggaaggaaggagaagaaguccaggugcuggcacuggagcccggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaauccagagaucgaagaugacauuuuccgaaagagaagacugaccaucauggaccuccacccaggagcgggaaagacaaaaagauaccuuccggccauagucagagaagcuauaaaacgggguuugagaacauuaaucuuggccccuacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacucgaguggagaugggugaggcagcugggauuuucaugacagccacucccccgggaaguagagauccauuuccccagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagagggucauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggccuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuauucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcucuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaagacgaagaaagaucuuggauuaggaagcauugcaacccagcaacccgagagcaacauccuggacauagaucuacgucccgcaucagcuuggacgcuguaugccguggcuacaacauuuguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcgggcaucaugaaaaacccaaccgucgauggaauaacagugauugaucuagauccaauaccuuaugauccaaaguuugaaaagcagcugggacaaguaaugcuacuaauccucugcgugacucaaguauugaugaugaggacuacaugggcucugugugaggccuuaaccuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcauugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacguuuucuucaucccgccagaaaagugugacacauuguugugugacauaggggagucaucaccaaaccccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuuccgggaacauagugucaucagugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaauggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaagcuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaggagggaggagccauguacgccgaugacacagcaggaugggacaccagaaucacacuagaagaccuaaaaaaugaagaaaugguaacaaaccacauggaaggagaacacaagaaauuagccgaggccauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaauugccgugcaaaacugguuggcaagaguggggcgcgaaagguuaucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 6713 - RNA, 9876 nt, Artificial Sequence
  derived and/or modified CDS sequence (wt) from DENV-2__FJ906958__SS-prME
ucuguaggcaugaucauuaugcugauuccaacaguaauggcguuccaucugaccacacgcaacggagaaccacauaugaucgucaguauacaagagaaagggaaaagucuccuguuuaaaacagaggauggcgugaacaugugcacccucauggccauggaccuuggugaauugugugaagacacaaucacguacaaguguccccuucucagacagaaugagccagaagacauagauuguuggugcaacuccacguccacguggguaaccuaugggacuuguaccaccacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucaucuugcugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucaccuucaaaaauccccaugcgaagaaacaggauguuguuguuuuaggaucccaagaaggggccaugcauacagcacucacaggagccacggaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacaauagucaucagagugcaauaugaaggggacggcucuccauguaaagucccuuuugagauaauggauuuggaaaaaagauaugucuuaggccgccugaucacagucaacccaguugugacagaaaaagauagcccagucaacauagaagcagaaccuccauucggagacagcuacaucaucauaggaguagagccgggacaacugaagcucaacugguucaagaaaggaaguucuaucggccagauguuugagacaacaaugaggggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguguuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagacuggagaaccuaauguggaaacagauaacaccagaauugaaucacauucuagcagaaaaugaggugaaguuaacuauuaugacaggagacaucaaaggaaucaugcaggcaggaaaacgaucucugcggccucagcccacugagcuaaaguacucauggaaaacauggggcaaagcaaaaaugcucuccacagagucucauaaccaaacuuuucucauugauggccccgaaacagcagaaugccccaacacaaauagagcuuggaacucauuggagguugaagacuacgguuuuggaguguucaccaccaauauauggcuaaaauugaaagaaaaacaggaugcauucugcgacucaaaacucaugucagcggccguaaaagacaacagagccguccaugccgacauggguuauuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguggugacugaggacugcggaaauagaggacccucuuugagaacaacuacugccucuggaaaacucauaacagaauggugcugccgaucuugcacauugccaccccuaagauauagaggugaggaugggugcugguacgggauggaaaucagaccauugaaagagaaagaagaaaauuugguuaacuccuuggucacagccggacaagggcagguugacaauuuuucacuaggagucuugggaauggcauuguuccuggaggaaaugcuuaggacccgaguaggaacgaaacaugcaauacuacuaguugcaguuucuuuugugacauugaucacagggaacauguccuuuaaagaccuaggaagaguggugguuaugguaggggccaccaugacggaugacauagguaugggcguaacuuaucuugcccuacuagcagccuuuaaagucagaccaacuuuugcagcuggacuacucuugagaaagcugaccuccaaggaauugaugaugaccaccauaggaauuguacuccucucucaaagcacuauaccagaaaccauccuugaauugacugaugcguuagccuuaggcaugaugguccucaaaauaguaagagacauggaaaaguaucaauuggcagugacuaucauggcuaucuugugcgucccaaacgcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucuaacaacucucucaagaaccaacaagaaaaggagcuggccacuaaaugaggccaucauggcagucggaauggugagcauuuuagccaguucucuccuaaaaaaugauaucccuaugacaggaccacuaguggcuggagggcuccucacuguaugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguacugugggauguuccuucacccccacccaugggaaaggcugaacuggaagauggagccuacagaaucaagcaaaaagggauucuuggauauucccagaucggagcuggaguuuauaaagaaggaacauuccauacgauguggcaugucacacguggcgcuguccuaaugcauaaaggaaagaggauugaaccaucaugggcggacgucaaaaaagaucuaauaucauauggaggaggcuggaagcuagaaggagaauggaaggaaggagaagaaguccaggugcuggcauuggagccugggaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuauggcaaugguguuguuacaaggaguggagcauaugugagugcuauagcccaaacugaaaaaagcauugaagacaacccagacaucgaagaugacauuuuccgaaagagaagacugaccaucauggaccuccacccaggagcgggaaagacgaaaagauaccuuccggccauagucagagaagccauaaaacgggguuugagaacauuaaucuuggcccccaccagaguuguggcagcugaaauggaggaggcucucagaggacuuccaauaagauaccaaaccccagccaucagagcugagcacacagggcgggaaauuguggaucuaaugugucaugccacauuuaccaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccgaucauagaugaagaaagagaaaucccugaacguucauggaauucuggacacgaguggguuacggauuuuaaagggaaaacuguuugguucguuccaagcauaaaagcaggaaaugauauagcagcuugccugagaaaaaauggaaagaaaguaauacaacuuaguaggaagacuuuugauucugaguaugccaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaggcaaggaaaaccuuuguggacuuaaugagaagaggagaccuaccagucuggcuggccuacaaaguggcagcugaaggcaucaacuaugcagacagaaggugguguuuugauggaaucaagaacaaccaaauccuggaagagaauguggaaguugaaauuuggacaaaagaaggggaaaggaagaaauugaaacccagauggcuggaugcuaggaucuacucugacccacuggcgcuaaaagaauucaaagaauuugcagccggaagaaagucucugacccugaaccuaauuacagaaauggguaggcuuccaacauucaugacucagaagacaagagacgcacuggacaacuuagcagugcugcauacggccgaagcagguggaagggcguacaaucaugcucucagugaacugccggagacccuggagacacugcuuuuacugacacuucuggcuacagucacgggagggaucuuuuuauucuugaugagcgggaggggcauagggaagaugacccugggaaugugcugcauagucacggcuagcauccuuuuaugguacgcacaaauacagccacacuggauagcagcuucaauaauacuggaguuuuuucucauaguuuugcuuauuccagaaccagaaaaacagagaacaccccaagacaaccaauuaaccuauguugucauagccauccucacagugguggccgcaaccauggcaaacgagauggguuuccuagaaaaaacgaagaaagaucuuggauuaggaagcauugcaacccagcaacccgagagcaacauccuggacauagaucuacgccccgcaucagcauggacgcuguaugccguggcuacaacauuuguuacaccaaugcugagacauaguauugagaauuccucagugaauguaucccuaacagcuauagcuaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccauuauagggccaggacuucaagcaaaagcaaccagagaagcucagaaaagagcagcggcgggcaucaugaaaaacccaaccguugauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuggcuaccgggcccaucuccacacugugggaaggaaauccaggaagguucuggaacacuaccauugcggugucaauggccaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaucuagugcgucuucaaaguggaguugacguuuucuucaucccgccagaaaagugugacacauuguugugugacauaggggagucaucaccaaauccuacaguggaagcaggacgaacacucagaguccuuaauuuaguagaaaauugguugaacaacaacacucaauuuugcauaaaaguucucaacccauauaugcccucaguuauagaaaaaauggaaacacugcaaaggaaauauggaggagccuuagugagaaauccacucucacggaacuccacacaugagauguacuggguauccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacgaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucgguaaggcaaaaggcagcagagccauaugguacauguggcucggagcucgcuuccuggaguuugaagcccuaggauuccuaaaugaagaucacugguucuccagagagaacuccuugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagagauuagccgaggccauuuucaaacuaacguaccaaaacaagguggugcgugugcaaagaccaacaccaagaggcacaguaauggacaucauaucaagaagagaccaaagagguagugggcaaguugguaccuauggacucaauacuuucaccaauauggaagcccaauuaaucagacagauggagggagaaggaguuuuuaaaaacauucagcaccugacagucacagaagaaaucgccgugcagaacugguuagcgagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugcccuucuguucacaccauuuccaugagcuaaucaugaaggacggucguguacuuguuguuccauguagaaaccaagaugaacugauuggcagagcccgaaucucccaaggagcaggguggucuuugcgggagacggccuguuuggggaagucuuacgcccaaauguggagcuugauguacuuccacagacgcgaccucagguuggcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguggaaucaugggaggaaaucccguacuuggggaaaagagaagaccaaugguguggcucacugauuggguugacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 6714 - RNA, 9876 nt, Artificial Sequence
  derived and/or modified CDS sequence (wt) from DENV-2__FJ898452__SS-prME
ucugcaggcaugaucauuaugcugauuccaacagugauggcguuccaucuaaccacacgcaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggaccuguaccacuacgggagaacauagaagagaaaaaagaucaguggcacucguuccacauguaggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagaguccugauuuucauucuacugacagcugucgcuccuucaaugacaaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaaggaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaggagcaugcggucggaaaugacacaggaaaacacggcaaggaaaucaaaguaacaccacagaguuccaucacagaagcagaauugacagguuauggcaccgucacgauggagugcuccccgagaacaggccucgacuucaaugagaugguguugcugcagauggaaaauaaagcuuggcuggugcauaggcaaugguuucuagaccugccauuaccauggcugcccggagcggauaaacaagagucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcuuaaaggaaugucauacuccaugugcacaggaaaguuuaaaguugugaaggaaauagcagaaacacaacauggaacgauagucaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaguguuuacaucuauaggaaaagcucuccaccaagucuuuggagcaaucuauggagcugccuucagugggguuucauggaccaugaaaauccucauaggagucauuaucacauggauaggaaugaacucacgcagcaccucacugucugugucacuaguacuggugggaauugugacacuguauuugggagucauggugcaggccgauagugguugcguugugagcuggaaaaacaaagaauugaaauguggcagugggauuuucaucacagacaacgugcacacauggacagaacaauacaaguuccaaccagaauccccuucaaaacuagcuucagcuauccagaaagcucaagaagagggaauuugugggauccgcucgguaacaagauuggagaaccuaauguggaaacaaauaacaccagaauugaaucacauucuagcagaaaaugaggugaaguugacuauuaugacaggagacaucaaaggaaucaugcaggcaggaaaacgaucuuugcggccucagcccacugagcuaaaguauucauggaaaacaugggguaaagcaaaaaugcucuccacggagucuuauaaccaaaccuuucucauugauggccccgagacggcagagugccccaacacaaauagagcuuggaacucguuggagguugaagacuacggcuuuggaguguucaccaccaauauauggcuaaaauugaaagaaaaacaggaugcauucugcgacucaaaacucaugucggcggccauaaaagacaacagagccguccaugccgacauggguuacuggauagaaagugcacucaaugacacauggaagauagagaaagccucuuucauugaaguaaaaaacugccacuggccaaaaucacacacccucuggaguaauggagugcuagaaagugagaugauaaucccaaagaaucucgcuggaccagugucucaacacaacuauagaccaggcuaccauacacaaauagcaggaccauggcaccuagguaagcuugagauggacuuugauuucugcgauggaaccacagugauagugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaaucugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgcuacaauggcggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaaguacuauaccagagaccguucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaagaagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuauaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuucauacaauguggcaugucacacguggcgcuguucuaaugcauaaaggaaagaggauugaaccuucaugggcggacgucaaaaaagaucuaauaucauauggaggaggcuggaagcuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucaucgacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccagccauagucagagaagccauaaaacgggguuugagaacauuaaucuuggcccccacuagaguuguggcagcugaaauggaggaggcucucagaggacuuccaauaagauaccaaaccccagccauuagagcugagcacacugggcgggaaauuguggaucuaaugugucaugccacauuuaccaugaggcugcuaucaccaguuagagugccaaacuauaacuugauuaucauggacgaagcccauuucacagacccagcaaguauagcagcuagaggauacaucucaacccgaguggaaaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagccgagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauuccuaguauguuugaaccagagcgugaaaaaguggaugccauugauggcgaauaccgucugagaggagaagcaaggaaaaccuuuguggacuugaugaggagaggagacuuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaguucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacccuagagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaggaucuuggauuaggaagcauugcaacccagcaacccgagagcaacauccuggacauagaccuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggauguuacucacaagucaaucccauaacucucacagcagcucuccucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaacuuuagcuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuggugcgucuucagaguggaguugacgucuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaauagauucacaaugagacacaagaaagccacuuacgagccggauguugaccucggaagcggaacccgaaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucucuagagagaacucccugaguggaguggaaggagaagggcugcacaagcuagguuacauucuaagagacgugagcaagaaagagggaggagccauguacgccgacgacacagcaggaugggacacaagaaucacacuagaagaccuaaaaaaugaagaaaugguaacaaaccauauggaaggagaacacaagaaauuggccgaggcuauuuucaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguugucaagaauggccaucaguggagaugauuguguugugaaaccuuuagaugacagguucgcaaacgcuuugacagcccuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgugaccucaggcuggcggcaaaugccauuugcucggcagugccaucacacuggguuccaacaagucgaacaaccugguccauacacgccaaacaugaauggaugacaacggaagacauguugacagucuggaacaggguguggauucgagaaaacccauggauggaagacaaaaccccaguggaaucaugggaggaaaucccauacuugggaaaaagagaagaccaauggugcggcucauugauuggguuaacaagcagggcuacaugggcaaagaacauccaagcagcaauaaaucagguuagaucucuuauaggcaaugaggaauacacagauuacaugccauccaugaaaagauucagaagagaagaggaagaagcaggaguccugugguaa

SEQ ID NO: 6715 - RNA, 9876 nt, Artificial Sequence
  derived and/or modified CDS sequence (wt) from DENV-2__GQ868591__SS-prME
ucugcaggcaugaucauuaugcugauuccaacagugauggcguuccauuuaaccacacguaacggagaaccacacaugaucgucagcagacaagagaaagggaaaagucuucuguuuaaaacagaggauggcgugaacauguguacccucauggccauggaccuuggugaauugugugaagacacaaucacguacaaguguccccuucucaggcagaaugagccagaagacauagacuguuggugcaacucuacguccacguggguaacuuaugggacguguaccaccaugggagaacauagaagagaaaaaagaucaguggcacucguuccacaugugggaaugggacuggagacacgaacugaaacauggaugucaucagaaggggccuggaaacauguccagagaauugaaacuuggaucuugagacauccaggcuucaccaugauggcagcaauccuggcauacaccauaggaacgacacauuuccaaagagcccugauuuucaucuuacugacagcugucacuccuucaaugacaaugcguugcauaggaaugucaaauagagacuuuguggaagggguuucaggaggaagcuggguugacauagucuuagaacauggaagcugugugacgacgauggcaaaaaacaaaccaacauuggauuuugaacugauaaaaacagaagccaaacagccugccacccuaaggaaguacuguauagaggcaaagcuaaccaacacaacaacagaaucucgcugcccaacacaaggggaacccagccuaaaugaagagcaggacaaaagguucgucugcaaacacuccaugguagacagaggauggggaaauggauguggacuauuuggaaagggaggcauugugaccugugcuauguucagaugcaaaaagaacauggaaggaaaaguugugcaaccagaaaacuuggaauacaccauugugauaacaccucacucaggggaagagcaugcagucggaaaugacacaggaaaacauggcaaggaaaucaaaauaacaccacagaguuccaucacagaagcagaauugacagguuauggcacugucacaauggagugcucuccaagaacgggccucgacuucaaugagaugguguugcugcagauggaaaauaaagcuuggcuggugcacaggcaaugguuccuagaccugccguuaccaugguugcccggagcggacacacaagggucaaauuggauacagaaagagacauuggucacuuucaaaaauccccaugcgaagaaacaggauguuguuguuuuaggaucccaagaaggggccaugcacacagcacuuacaggggccacagaaauccaaaugucaucaggaaacuuacucuucacaggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccaugcaagaucccuuuugagauaauggauuuggaaaaaagacaugucuuaggucgccugauuacagucaacccaauugugacagaaaaagauagcccagucaacauagaagcagaaccuccauucggagacagcuacaucaucauaggaguagagccgggacaacugaagcucaacugguuuaagaaaggaaguucuaucggccaaauguuugagacaacaaugaggggggcgaagagaauggccauuuuaggugacacagccugggauuuuggauccuugggaggaguguuuacaucuauaggaaaggcucuccaccaagucuuuggagcaaucuauggagcugccuucagugggguuucauggacuaugaaaauccucauaggagucauuaucacauggauaggaaugaauucacgcagcaccucacugucugugacacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcccaugaagagggcauuuguggaauccguucaguaacaagacuggagaaucugauguggaaacaaauaacaccagaauugaaucacauucuaucagaaaaugaggugaaguuaacuauuaugacaggagacaucaaaggaaucaugcaggcaggaaaacgaucucugcggccucagcccacugagcugaaguauucauggaaaacauggggcaaagcaaaaaugcucucuacagagucucauaaccagaccuuucucauugauggccccgaaacagcagaaugccccaacacaaauagagcuuggaauucguuggaaguugaagacuauggcuuuggaguauucaccaccaauauauggcuaaaauugaaagaaaaacaggauguauucugcgacucaaaacucaugucagcggccauaaaagacaacagagccguccaugccgauauggguuauuggauagaaagugcacucaaugacacauggaagauagagaaagccucuuucauugaaguuaaaaacugccacuggccaaaaucacacacccucuggagcaauggagugcuagaaagugagaugauaauuccaaagaaucucgcuggaccagugucucaacacaacuauagaccaggcuaccauacacaaauaacaggaccauggcaucuagguaagcuugagauggacuuugauuucugugauggaacaacagugguagugacugaggacugcggaaauagaggacccucuuugagaacaaccacugccucuggaaaacucauaacagaauggugcugccgaucuugcacauuaccaccgcuaagauacagaggugaggaugggugcugguacgggauggaaaucagaccauugaaggagaaagaagagaauuuggucaacuccuuggucacagcuggacaugggcaggucgacaacuuuucacuaggagucuugggaauggcauuguuccuggaggaaaugcuuaggacccgaguaggaacgaaacaugcaauacuacuaguugcaguuucuuuugugacauugaucacagggaacauguccuuuagagaccugggaagagugaugguuaugguaggcgccacuaugacggaugacauagguaugggcgugacuuaucuugcccuacuagcagccuucaaagucagaccaacuuuugcagcuggacuacucuugagaaagcugaccuccaaggaauugaugaugacuacuauaggaauuguacuccucucccagagcaccauaccagagaccauucuugaguugacugaugcguuagccuuaggcaugaugguccucaaaauggugagaaauauggaaaaguaucaauuggcagugacuaucauggcuaucuugugcgucccaaacgcagugauauuacaaaacgcauggaaagugaguugcacaauauuggcagugguguccguuuccccacugcucuuaacauccucacagcaaaaaacagauuggauaccauuagcauugacgaucaaaggucucaauccaacagcuauuuuucuaacaacccucucaagaaccagcaagaaaaggagcuggccauuaaaugaggcuaucauggcagucgggauggugagcauuuuagccaguucucuccuaaaaaaugauauucccaugacaggaccauuaguggcuggagggcuccucacugugugcuacgugcucacuggacgaucggccgauuuggaacuggagagagcagccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccacccaugggaaaggcugaacuggaagauggagccuauagaauuaagcaaaaagggauucuuggauauucccagaucggagccggaguuuacaaagaaggaacauuccauacaauguggcaugucacacguggcgcuguucuaaugcauaaaggaaagaggauugaaccaucaugggcggacgucaagaaagaccuaauaucauauggaggaggcuggaaguuagaaggagaauggaaggaaggagaagaaguccagguauuggcacuggagccuggaaaaaauccaagagccguccaaacgaaaccuggucuuuucaaaaccaacgccggaacaauaggugcuguaucucuggacuuuucuccuggaacgucaggaucuccaauuaucgacaaaaaaggaaaaguugugggucuuuaugguaaugguguuguuacaaggaguggagcauaugugagugcuauagcccagacugaaaaaagcauugaagacaacccagagaucgaagaugacauuuuccgaaagagaagacugaccaucauggaccuccacccaggagcgggaaagacgaagagauaccuuccggccauagucagagaagcuauaaaacgggguuugagaacauuaaucuuggcccccacuagaguuguggcagcugaaauggaggaagcccuuagaggacuuccaauaagauaccagaccccagccaucagagcugagcacaccgggcgggagauuguggaccuaaugugucaugccacauuuaccaugaggcugcuaucaccaguuagagugccaaacuacaaccugauuaucauggacgaagcccauuucacagacccagcaaguauagcagcuagaggauacaucucaacucgaguggagaugggugaggcagcugggauuuuuaugacagccacucccccgggaagcagagacccauuuccucagagcaaugcaccaaucauagaugaagaaagagaaaucccugaacguucguggaauuccggacaugaaugggucacggauuuuaaagggaagacuguuugguucguuccaaguauaaaagcaggaaaugauauagcagcuugccugaggaaaaauggaaagaaagugauacaacucaguaggaagaccuuugauucugaguaugucaagacuagaaccaaugauugggacuucgugguuacaacugacauuucagaaaugggugccaauuucaaggcugagaggguuauagaccccagacgcugcaugaaaccagucauacuaacagauggugaagagcgggugauucuggcaggaccuaugccagugacccacucuagugcagcacaaagaagagggagaauaggaagaaauccaaaaaaugagaaugaccaguacauauacaugggggaaccucuggaaaaugaugaagacugugcacacuggaaagaagcuaaaaugcuccuagauaacaucaacacgccagaaggaaucauuccuagcauguucgaaccagagcgugaaaagguggaugccauugauggcgaauaccgcuugagaggagaagcaaggaaaaccuuuguagacuuaaugagaagaggagaccuaccagucugguuggccuacagaguggcagcugaaggcaucaacuacgcagacagaaggugguguuuugauggagucaagaacaaccaaauccuagaagaaaacguggaaguugaaaucuggacaaaagaaggggaaaggaagaaauugaaacccagaugguuggaugcuaggaucuauucugacccacuggcgcuaaaagaauuuaaggaauuugcagccggaagaaagucucugacccugaaccuaaucacagaaauggguaggcucccaaccuucaugacucagaaggcaagagacgcacuggacaacuuagcagugcugcacacggcugaggcagguggaagggcguacaaccaugcucucagugaacugccggagacccuggagacauugcuuuuacugacacuucuggcuacagucacgggagggaucuuuuuauucuugaugagcggaaggggcauagggaagaugacccugggaaugugcugcauaaucacggcuagcauccuccuaugguacgcacaaauacagccacacuggauagcagcuucaauaauacuggaguuuuuucucauaguuuugcuuauuccagaaccugaaaaacagagaacaccccaagacaaccaacugaccuacguugucauagccauccucacagugguggccgcaaccauggcaaacgagauggguuuccuagaaaaaacgaagaaagaucucggauugggaagcauugcaacccagcaacccgagagcaacauccuggacauagaucuacguccugcaucagcauggacgcuguaugccguggccacaacauuuguuacaccaauguugagacauagcauugaaaauuccucagugaaugugucccuaacagcuauagccaaccaagccacaguguuaaugggucucgggaaaggauggccauugucaaagauggacaucggaguuccccuucucgccauuggaugcuacucacaagucaaccccauaacucucacagcagcucuuuucuuauugguagcacauuaugccaucauagggccaggacuccaagcaaaagcaaccagagaagcucagaaaagagcagcggcgggcaucaugaaaaacccaacugucgauggaauaacagugauugaccuagauccaauaccuuaugauccaaaguuugaaaagcaguugggacaaguaaugcuccuaguccucugcgugacucaaguauugaugaugaggacuacaugggcucugugugaggcuuuaaccuuagcuaccgggcccaucuccacauugugggaaggaaauccagggagguuuuggaacacuaccauugcggugucaauggcuaacauuuuuagagggaguuacuuggccggagcuggacuucucuuuucuauuaugaagaacacaaccaacacaagaaggggaacuggcaacauaggagagacgcuuggagagaaauggaaaagccgauugaacgcauugggaaaaagugaauuccagaucuacaagaaaaguggaauccaggaaguggauagaaccuuagcaaaagaaggcauuaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaagaauguaagagaagucaaaggccuaacaaaaggaggaccaggacacgaagaacccauccccaugucaacauauggguggaaucuagugcgucuucaaaguggaguugacguuuucuucaucccgccagaaaagugugacacauuauugugugacauaggggagucaucaccaaaucccacaguggaagcaggacgaacacucagaguccuuaacuuaguagaaaauugguugaacaacaacacucaauuuugcauaaagguucucaacccauauaugcccucagucauagaaaaaauggaagcacuacaaaggaaauauggaggagccuuagugaggaauccacucucacgaaacuccacacaugagauguacuggguauccaaugcuuccgggaacauagugucaucagugaacaugauuucaaggauguugaucaacagauuuacaaugagauacaagaaagccacuuacgagccggauguugaccucggaagcggaacccguaacaucgggauugaaagugagauaccaaaccuagauauaauugggaaaagaauagaaaaaauaaagcaagagcaugaaacaucauggcacuaugaccaagaccacccauacaaaacgugggcauaccaugguagcuaugaaacaaaacagacuggaucagcaucauccauggucaacggaguggucaggcugcugacaaaaccuugggacgucguccccauggugacacagauggcaaugacagacacgacuccauuuggacaacagcgcguuuuuaaagagaaaguggacacgagaacccaagaaccgaaagaaggcacgaagaaacuaaugaaaauaacagcagaguggcuuuggaaagaauuagggaagaaaaagacacccaggaugugcaccagagaagaauucacaagaaaggugagaagcaaugcagccuugggggccauauucgcugaugagaacaaguggaagucggcacgugaggcuguugaagauaguagguuuugggagcugguugacaaggaaaggaaucuccaucuugaaggaaagugugaaacauguguguacaacaugaugggaaaaagagagaagaagcuaggggaauucggcaaggcaaaaggcagcagagccauaugguacauguggcuuggagcacgcuucuuagaguuugaagcccuaggauucuuaaaugaagaucacugguucuccagagagaacucccugaguggaguggaaggagaagggcugcacaagcuagguuacauucuaagagacgugagcaagaaagagggaggagcaauguaugccgaugacaccgcaggaugggauacaagaaucacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguaguggacaaguuggcaccuauggacucaauacuuucaccaauauggaagcccaacuaaucagacagauggagggagaaggagucuuuaaaagcauucagcaccuaacaaucacagaagaaaucgcugugcaaaacugguuagcaagaguggggcgcgaaagguuaucaagaauggccaucaguggagaugauuguguugugaaaccuuuagaugacagguucgcaagcgcuuuaacagcucuaaaugacaugggaaagauuaggaaagacauacaacaaugggaaccuucaagaggauggaaugauuggacacaagugcccuucuguucacaccauuuccaugaguuaaucaugaaagacggucgcguacucguuguuccauguagaaaccaagaugaacugauuggcagagcccgaaucucccaaggagcaggguggucuuugcgggagacggccuguuuggggaagucuuacgcccaaauguggagcuugauguacuuccacagacgcgaccucaggcuggcggcaaaugcuauuugcucggcaguaccaucacauuggguuccaacaagucgaacaaccugguccauacaugcuaaacaugaauggaugacaacggaagacaugcugacagucuggaacaggguguggauucaagaaaacccauggauggaagacaaaacuccaguggaaucaugggaggaaaucccauacuuggggaaaagagaagaccaauggugcggcucauugauuggguuaacaagcagggccaccugggcaaagaacauccaagcagcaauaaaucaaguuagaucccuuauaggcaaugaagaauacacagauuacaugccauccaugaaaagauucagaagagaagaggaagaagcaggaguucugugguag

SEQ ID NO: 6716 - RNA, 9876 nt, Artificial Sequence
  derived and/or modified CDS sequence (wt) from DENV-2__GQ868542__SS-prME
ucugcaggcaugaucauuaugcugauuccaacagugauggcguuccaucuaaccacacguaacggagaaccacacaugaucgucaguauacaagagaaagggaaaagucuucuguuuaaaacagaggauggcgugaacaugugcacccucauggccauggaccuuggugaauugugugaagacacaaucacguacaaguguccccuucucaggcagaaugagccagaagacauagacuguuggugcaacuccacguccacguggguaaccuaugggacuuguaccaccacgggagaacauagaagagaaaaaagaucaguggcacucguuccacaugugggaaugggacuggagacgcgaaccgaaacauggaugucgucagaaggggcuuggaaacaugcccagagaauugaaacuuggauccugagacauccaggcuucaccauaauggcagcaaucuuggcauacaccauagggacgacacauuuccagagagcccugauuuucauccuacugacagcugucgcuccuucaaugacaaugcguuguauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacacuccaugguagacagaggauggggaaauggauguggauuauuuggaaagggaggcauuguaaccugugcuauguucacaugcaaaaagaacauggaagggaaaaucgugcaaccagaaaacuuggaauacaccauugugguaacaccucacucaggggaagagcaugcaguuggaaaugacacaggaaaacauggcaaggaaaucaaaguaacaccacagaguuccauuacagaagcagaauugacagguuauggcaccgucacgauggagugcucuccgaggacaggccucgacuuuaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugaggauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauugugacagaaaaagauagcccaguuaacauagaagcagaaccuccauucggagacagcuacaucaucauaggaguagagccgggacaacugaagcucaacugguucaagaaaggaaguucuaucggccaaauguuugagacaacaaugaggggggcgaagagaauggccauuuugggugacacagccugggauuucggaucccugggaggaguguucacaucuauaggaaaagcucuccaccaagucuuuggagcaaucuauggagcugccuucagugggguuucauggacaaugaaaauccucauaggagucauuaucacauggauaggaaugaacucacgcagcaccucacugucugugucacuaguauuggugggaauugugacacuguauuugggagucauggugcaggccgauagugguugcguugugagcuggaaaaacaaagaacugaaauguggcagugggauuuucauuacagacaacgugcacacauggacagaacaauacaaguuccaaccagaauccccuucaaaacuagcuucagcuauccagaaagcucaagaagagggaauuugugggauccgcucaguaacaagauuggaaaaccuaauguggaaacaaauaacaccagaauugaaucacauucuagcagaaaaugaggugaaguuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucucauugauggcccugaaacggcagaaugccccaacacaaauagagcuuggaacucguuggagguugaagacuacggcuuuggaguguucaccaccaauauauggcuaaaauugaaagaaaaacaggaugcauucugcgacucaaaacuuaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaauuauagaccaggcuaccauacacaaauagcaggaccauggcaucuagguaagcuugaaauggacuuugauuucugcgauggaaccacagugguagugacugaggacuguggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucacugggagucuugggaauggcauuguuccuggaggaaaugcuuaggacccgaguaggaacgaaacaugcaauacuacuaguugcaguuucuuuugugacauugaucacagggaacauguccuucaaagaccuaggaagagugguggucaugguaggcgccaccaugacggaugacauagguaugggcgugacuuaccuugcccuacuagcagccuucaaaguuagaccaacuuuugcagcuggacuacucuugagaaagcugaccuccaaggaauugaugaugaccaccauaggaaucguacuccucucccaaagcacuauaccagagaccauucuugaauugacugaugcguuagccuuaggcaugaugguccucaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgacgucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccgggguauugugggacguuccuucacccccacccaugggaaaggcugaacuggaagauggagccuacagaaucaagcaaaaagggauucuuggauauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaagguugugggucuuuaugguaaugguguuguuacaaggaguggagcauaugugagugcuauagcccaaacugaaaaaagcauugaagacaacccagagaucgaagaugacauuuuccgaaagagaagacugaccaucauggaccuccacccaggagcgggaaagacgaaaagauaccuuccggccauagucagagaagcuauaaaacgggguuugagaacauuaaucuuggcucccaccagaguuguggcagcugaaauggaggaagcucucagaggacucccaauaagauaccaaaccccagccaucagagcugagcacacugggcgggaaauuguggaucuaaugugucaugccacauuuacuaugaggcugcuaucaccaguuagagugccaaacuacaaccugauuaucauggacgaagcccauuucacagacccagcaaguauagcagcuagaggguacaucucaacucgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuucgauucugaguaugucaagacuagaaccaaugauugggauuucgugguuacaacugacauuucagaaaugggugccaauuucaaagcugagaggguuauagaccccagacgaugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggggaaccucuggaaaaugaugaggacugugcacacuggaaagaagccaaaaugcuccuagauaacaucaacacaccagaaggaaucauucccaguauguuugaaccagagcgugaaaaaguggaugccauugauggugaauaccgcuugagaggagaagcaaggaaaaccuuuguggacuuaaugagaagaggagaccuaccagucugguuggccuacaaaguggcagcugaaggcaucaacuaugcagacagaaggugguguuuugauggaauuaagaacaaccaaauucuggaagaaaauguggaaguugaaaucuggacaaaggaaggggaaaggaagaaauugaaacccagauggcuggaugcuaggaucuauucugacccacuggcgcuaaaagaauucaaagaauucgcagccggaaggaagucccugacccugaaccuaaucacagaaauggguaggcuuccaacauucaugacucagaagacaagagacgcacuggacaacuuggcggugcugcacacggcugaagcagguggaagggcguacaaucaugcucucagugaacugccggagacccuggagacacugcuuuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagaugggcuuccuagaaaaaacgaagaaagaucuuggauuaggaggcauugcaacccagcaacccgagagcaacauccuggacauagaucuacgucccgcaucagcauggacgcuguaugccguggcuacaacauuugucacaccaaugcugagacauagcauugagaauuccucagugaauguaucccuaacagcuauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccaucauagggccaggacuucaagcaaaagcaaccagagaagcucagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacugguaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaucuagugcgucuucagaguggaguugacguuuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguccucaacccauauaugcccucagucauagaaaaaauggaagcacugcaaaggaaauauggaggagccuuagugagaaauccacucucacggaacuccacacaugagauguacuggguauccaaugcuuccgggaacauagugucaucagugaacaugauuucaaggauguugaucaacagauucacaaugagacacaagaaagccacuuacgagccggacguugaccucggaagcggaacccguaacauuggaauugaaagugagguaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaaaucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggaaccauguaugccgaugauacagcaggaugggacacaagaaucacacuagaagaccuaaaaaaugaagaaaugguaacaaaccacauggaaggagaacacaagaaauuagccgaggccauuuuuaaacuaacguaucaaaacaagguggugcgugugcaaagaccaacaccaagaggcacaguaauggacaucauaucgagaagagaccaaagagguagugggcaaguugguaccuauggacucaauacuuucaccaauauggaagcccaauuaaucagacagauggagggagaaggaguuuuuaaaaacauucagcaccugacagucacagaagaaaucgccgugcaaaacugguuagcaagaguggggcgcgaaagguuaucaagaauggccaucaguggagaugauuguguugugaaaccucuagaugacagguucgcaagcgcuuugacagcucuaaaugacaugggaaagauuagaaaagacauacaacaaugggaaccuucaagaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacagacgcgaccucagacuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggauucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 6717 - RNA, 9876 nt, Artificial Sequence
  derived and/or modified CDS sequence (wt) from DENV-2__GQ868544__SS-prME
ucuguaggcaugaucauuaugcugauuccaacaguaauggcguuccaucugaccacacgcaacggagaaccacauaugaucgucaguauacaagagaaagggaaaagucuccuguuuaaaacagaggauggcgugaacaugugcacccucauggccauggaccuuggugaauugugugaagacacaaucacguacaaguguccccuccucagacagaaugagccagaagacauagauuguuggugcaacuccacguccacguggguaaccuaugggacuuguaccaccacgggagaacacagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucaucuugcugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguugcccaacacaaggggaacccagccuaaaagaagagcaggauaagagguucgucugcaaacauuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauacacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacucuaugugcacaggaaaguuuaaaguugugaaggaaauagcagaaacacaacauggaacaauaguuaucagagugcaauaugaaggggacggcucuccauguaaagucccuuuugagauaauggauuuggaaaaaagauaugucuuaggccgccugaucacagucaacccaauugugacagaaaaagauagcccagucaacauagaagcagaaccuccauucggagacagcuacaucaucauaggaguagagccgggacaacugaagcucaacugguucaagaaaggaaguucuaucggccagauguuugagacaacaaugaggggggcgaagagaauggccauauugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguguuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagacuggagaaccuaauguggaaacagauaacaccagaauugaaucacauucuagcagaaaaugaggugaaguuaacuauuaugacaggagacaucaaaggaaucaugcaggcaggaaaacgaucucugcggccucagcccacugagcuaaaguauucauggaaaacauggggcaaagcaaaaaugcucuccacagagucucauaaccaaacuuuucucauugauggccccgaaacagcagaaugccccaacacaaauagagcuuggaacucauuggagguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgccggaccagugucucaacacaacuauagaccaggcuaccauacacaaauagcaggaccauggcaucuagguaagcuugagauggacuuugauuucugcgauggaacuacagugguggugacugaggacugcggaaauagaggacccucuuugagaacaacuacugccucuggaaaacucauaacagaauggugcugccgaucuugcacauuaccaccccuaagauauagaggugaggaugggugcugguacgggauggaaaucagaccauugaaagagaaagaagaaaauuugguuaacuccuuggucacagccggacaagggcagauugacaauuuuucacuaggagucuugggaauggcauuguuccuggaggaaaugcuuaggacccgaguaggaacgaaacaugcaauacuacuaguugcaguuucuuuugugacauugaucacagggaacauguccuuuaaagaccuaggaagaguggugguuaugguaggggccaccaugacggaugacauagguaugggcguaacuuaucuugcccuacuagcagccuuuaaagucagaccaacuuuugcagcuggacuacucuugagaaagcugaccuccaaggaauugaugaugaccaccauaggaauuguacuccucucccaaagcacuauaccagaaaccauccuugaauugacugaugcguuagccuuaggcaugaugguccucaaaauaguaagagacauggaaaaguaucaauuggcagugacuaucauggcuaucuugugcgucccaaacgcagugauauuacaaaaugcauggaaagugaguugcacaauacuagcagugguguccguuuccccacugcuuuugacauccucacagcaaaaaacggauuggauaccauuagcauugacaaucaagggucucaauccaacagccaucuuucuaacaacucucucaagaaccaacaagaaaaggagcuggccacuaaaugaggccaucauggcagucggaauggugagcauuuuagccaguucucuccuaaaaaaugauauccccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacuuauuagaacaggauugcuggugaucucaggacuuuuuccuguaucaauaccaauuacggcagcagcaugguaccugugggaagugaagaaacaacgggccggaguauugugggauguuccuucacccccacccaugggaaaggcugaacuggaagauggagccuacagaaucaagcaaaaagggauucuuggauauucccagaucggagcuggaguuuauaaagaaggaacauuccauacgauguggcaugucacacguggcgcuguccuaaugcauaaaggaaagaggauugaaccaucaugggcggacgucaaaaaagaucuaauaucauauggaggaggcuggaagcuggaaggagaauggaaggaaggagaagaaguccaggugcuggcauuggagccugggaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuauggcaaugguguuguuacaaggaguggagcauaugugagugcuauagcccaaacugaaaaaagcauugaagacaacccagacaucgaagaugacauuuuccgaaagagaagacugaccaucauggaccuccacccaggagcgggaaagacgaaaagauaccuuccggccauagucagagaagccauaaaacgggguuugagaacauuaaucuuggcccccaccagaguuguggcagcugaaauggaggaagcucucagaggacuuccaauaagauaccaaaccccagccauuagagcugagcacacagggcgggaaauuguggaucuaaugugucaugccacauuuacuaugaggcugcuaucaccaguuagagugccaaacuacaaccugauuaucauggaugaagcccauuucacagacccagcaaguauagcagcuagaggauacaucucaacucgaguggagaugggugaagcagcugggauuuucaugacagccacucccccgggaagcagagauccauuuccucagagcaaugcaccgaucauagaugaagaaagagaaaucccugaacguucauggaauucuggacacgaguggguuacggauuuuaaagggaaaacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggacccaugccagugacccacucuagugcagcacaaagaagagggagaauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaagcaaggaaaaccuuuguggacuuaaugagaagaggagaccuaccagucuggcuggccuacaaaguggcagcugaaggcaucaacuaugcagacagaaggugguguuuugauggaaucaagaacaaccaaauccuggaagagaauguggaaguugaaaucuggacaaaagaaggggaaaggaagaaauugaaacccagauggcuggaugcuaggaucuacucugacccacuggcgcuaaaagaauucaaagaauuugcagccggaagaaagucucugacccugaaccuaauuacagaaauggguaggcuuccaacauucaugacccagaagacaagagacgcacuggacaacuuagcagugcugcacacggccgaagcagguggaagggcguacaaucaugcucucagugaacugccggagacccuggagacacugcuuuuacugacacuucuggcuacagucacgggagggaucuuuuuauucuugaugagcgggaggggcauagggaagaugacccugggaaugugcugcauagucacggcuagcauccuuuuaugguacgcacaaauacagccacacuggauagcagccucaauaauacuggaguuuuuucucauaguuuugcuuauuccagaaccagaaaaacagagaacaccccaagacaaccaacuaaccuauguugucauagccauccucacagugguggccgcaaccauggcaaacgagauggguuuccuagaaaaaacgaagaaagaucuuggauuaggaagcauugcaacccagcaacccgagagcaacauccuggacauagaucuacgccccgcaucagcauggacguuguaugccguggcuacaacauuuguuacaccaaugcugagacauaguauugagaauuccucagugaauguaucccuaacagcuauagcuaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccauuauagggccaggacuucaagcaaaagcaaccagagaagcucagaaaagagcagcggcgggcaucaugaaaaacccaaccguugauggaauaacagugauugaucuagauccaauaccuuaugauccaaaguuugaaaagcaguugggacaaguaaugcuccuaguccucugcgugacucaaguauugaugaugagaacuacaugggcucugugugaggccuuaaccuuagcuaccgggcccauuuccacacugugggaaggaaauccaggaagguucuggaacacuaccauugcgguaucaauggcuaacaucuuuagagggaguuacuuggcuggagcuggacuucucuuuuccauuaugaagaacacaaccaacacaagaaggggaacuggcaauauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaauauggucacaccagaagggaaaguaguggaccucgguuguggcagaggaggcuggucauacuauuguggaggacuaaaaaacguaagagaagugaaaggccuaacaaaaggaggaccaggacacgaagaacccauccccaugucaacauauggguggaaccuagugcgucuucaaaguggaguugacguuuucuucaucccgccagaaaagugugacacauuguugugugacauaggggagucaucaccaaauccuacaguggaagcaggacgaacacucagaguccuuaauuuaguagaaaauugguugaacaacaacacucaauuuugcauaaaaguucucaacccauauaugcccucaguuauagaaaaaauggaaacacugcaaaggaaauauggaggagccuuagugagaaauccacucucacggaacuccacacaugagauguacuggguauccaaugcuuccgggaacauagugucaucagugaacaugauuucaaggauguugaucaacagauucacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaacccugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauagcagguuuugggagcugguugacaaggaaaggaaucuccaucuugaaggaaagugugaaacauguguguacaacaugaugggaaaaagagaaaagaagcuaggggaauucggcaaggcaaaaggcagcagagccauaugguacauguggcuuggagcucgcuucuuggaguuugaagcccuaggauuccuaaaugaagaucacugguucuccagagagaacuccuugaguggaguggaaggagaagggcuguacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaauuagccgaggccauuuucaaacuaacguaccaaaacaagguggugcgugugcaaagaccaacaccaagaggcacaguaauggacaucauaucaagaagagaccaaagagguagugggcaaguugguaccuauggacucaauacuuucaccaauauggaagcccaauuaaucagacagauggagggagaaggaguuuuuaaaaacauucagcaccugacagucacagaagaaaucgcugugcagaacugguuagcgagaguggggcgcgaaagguuaucaagaauggccaucaguggagaugauuguguugugaaaccuuuagaugacagguucgcgagcgcuuugacagcucuaaaugacaugggaaagauuagaaaagacauacaacaaugggaaccuucaagaggauggaacgauuggacacaagugccuuucuguucacaccauuuccaugagcuaaucaugaaggauggucguguacucguuguuccauguagaaaccaagaugaacugauuggcagagcccgaaucucccaaggagcaggguggucuuugcgggagacggccuguuuggggaagucuuacgcccaaauguggagcuugauguacuuccacagacgcgaccucagguuggcggcaaaugccauuugcucggcagugccaucacauuggguuccaacaagucgaacaaccugguccauacacgccaaacaugaauggaugacaacggaagacaugcugacagucuggaauaggguguggauucaagaaaacccauggauggaagacaaaaccccaguggaaucaugggaggaaaucccguacuuggggaaaagagaagaccaauggugcggcucacugauuggguuaacaagcagggccacaugggcaaagaacauccaagcagcaauaaaucaaguuagaucucucauaggcaaugaggaauacacagauuacaugccauccaugaaaagauucagaagagaagaggaagaagcaggaguccugugguag

SEQ ID NO: 6718 - RNA, 9876 nt, Artificial Sequence
  derived and/or modified CDS sequence (wt) from DENV-2__GQ868545__SS-prME
ucugcaggcaugaucauuaugcugauuccaacaguaauggcguuccaucuaaccacacgcaacggagaaccacacaugaucgucaguauacaagagaaagggaaaagucuucuguuuaagacugaggauggcgugaacaugugcacccucauggccauggaccuuggugaauugugugaagacacaaucacguacaaguguccccuucuaaggcagaaugagccagaagacauagacuguuggugcaacuccacguccacguggguaaccuaugggacuuguaccaccacgggagaacauagaagagaaaaaagaucaguggcacuuguuccacaugugggaaugggacuggagacgcgaaccgaaacauggaugucaucagaaggggcuuggaaacaugcccagagaaucgaaacuuggauccugagacauccaggcuucaccauaauggcagcaauccuggcauacaccauagggacgacacauuuccagagagcccugauuuucauccuacugacagcugucgcuccuucaaugacaaugcguugcauaggaauaucaaauagagacuuuguagaagggguuucaggaggaagcuggguugacauagucuuagaacauggaagcugugugacgacgauggcaaaaaacaaaccaacauuggauuuugaacugauaaaaacggaagccaaacagccugccacccuaaggaaguacugcauagaagcaaagcuaaccaacacaacaacagaaucucguuguccaacacaaggggaacccagccuaaaagaagagcaggauaagagguucgucugcaaacacuccauaguagacagaggguggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacauggcaaggaaaucaaagugacaccacagaguuccgucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggacacacaagggucaaauuggauacagaaagaaacauuggucacuuucaaaaacccccaugcgaagaaacaggauguuguuguuuuaggaucccaagaaggggccaugcauacagcacucacaggagccacagaaauccaaaugucgucaggaaacuuacucuucacuggacaucucaagugcaggcugagaauggacaagcuacagcucaaaggaaugucauacuccaugugcacaggaaaguucaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauugugacagaaaaagauagcccaguuaacauagaagcagaaccuccauucggagacagcuacauuaucauaggaguagagccgggacaacugaagcucaacugguucaagaaaggaaguucuaucggccaaauguuugagacaacaaugaggggggcgaagagaauggccauuuugggugacacagccugggauuucggaucccugggaggaguguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguauugguaggaauugugacacuguacuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugagguaaaauuaacuaucaugacaggagacaucaaaggaaucaugcaggcaggaaaacgaucucugcggccucagcccacugagcuaaaguauucauggaaaacauggggcaaagcaaaaaugcucuccacagagucucauaaccaaaccuuucuuauugauggccccgaaacagcagaaugccccaacacaaauagagcuuggaacucguuggagguugaagacuacgguuuuggaguguucaccaccaauauauggcuaaaauugaaagaaaaacaggaugcauucugcgacucaaaacucaugucagcggccauaaaagacaacagagccguccaugccgacauggguuauuggauagaaagugcacucaaugacacauggaagauagaaaaagccucuuucauugaaguaaaaaacugccacuggccaaagucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguagugacugaggacugcggaaauagaggacccucuuuaagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagauugacaauuuuucacuaggagucuugggaauggcauuguuccuggaggaaaugcuuaggacccgaguaggaacgaaacaugcaauacuacuaguugcaguuucuuuugugacauugaucacagggaacauguccuuuaaagaccuaggaagaguggugguuauggugggcgccaccaugacggaugacauagguaugggcguaacuuaucuugcccuacuagcagccuucaaagucagaccaacucuugcagcuggacuacucuugagaaaacugaccuccaaggaauugaugaugacuaccauaggaauuguacuccucucccaaagcacuauaccagagaccauucuugaauugacugaugcgcuagccuuaggcaugaugguccucaaaauaguaagagacauggaaaaguaucaauuagcagugacuaucauggcuaccuugugcgucccaaacgcagugauauuacaaaaugcauggaaagugaguugcacaauacuagcagugguauccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucucuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggauguuccuucacccccacccaugggaaaggcugaacuggaagauggagccuacagaaucaagcaaaaagggauucuuggguauucccagaucggagcuggaguuuauaaagaaggaacauuccauacaauguggcaugucacacguggcgcuguccuaaugcauaaaggaaagaggauugaaccaucaugggcggacgucaaaaaagaucuaauaucauauggaggaggcuggaagcuagaaggagaauggaaggaaggagaagaaguccaggugcuggcauuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguuguuacaaggaguggagcauaugugagugcuauagcccaaacugaaaaaagcauugaagacaacccagacaucgaagaugacauuuuccgaaagagaagacugaccaucauggaccuccacccaggagcgggaaagacgaaaagauaccucccggccauagucagagaagcuauaaaacgggguuugagaacauuaaucuuggcccccaccagagucguggcagcugaaauggaggaagcucucagaggacuuccaauaagauaccaaaccccagccaucagagcugagcacacagggcgggaaauuguggaucuaaugugucaugccacauuuaccaugaggcugcuaucaccaguuagagugccaaacuacaacuugauuaucauggaugaagcccauuucacagacccagcaaguauagcagcuagaggauacaucucaacucgaguggagaugggugaagcagcugggauuuucaugacagccacuccuccgggaagcagagauccauuuccucagagcaaugcaccaaucauagaugaagaaagagaaaucccugaacguucauggaauucuggacaugagugggucacggauuuuaaagggaagacugucugguucguuccaagcauaaaagcaggaaaugauauagcagcuugccugagaaaaaauggaaagaaagugauacaacuuaguaggaagacuuuugauucugaguaugucaagacuagaaccaaugauugggauuucgugguuacaacugacauuucagaaaugggugccaauuucaaggcugagaggguuauagaccccagacgcugcaugaaaccagucauacuaacagauggugaggagcgggugauucuggcaggaccuaugccagugacccacucuagugcagcgcaaagaagagggaggauaggaagaaauccaaaaaaugaaaaugaccaguacauauacaugggggaaccucuggaaaaugaugaagacugugcacacuggaaagaagccaaaaugcuccuagauaacauuaacacaccagaaggaaucauucccaguauguuugaaccagagcgugaaaagguggaugccauugauggcgaauaccgcuugagaggagaagcaaggaaaaccuuuguggaccuaaugagaagaggagaccuaccagucugguuggccuacaaaguggcagcugaaggcaucaacuaugcagacagaaggugguguuuugauggaaucaagaacaaccaaauccuggaagagaauguagaaguugaaaucuggacaaaagaaggggaaaggaagaaauugaaacccagauggcuggaugcuaggaucuacucugacccacuggcgcuaaaagaauucaaagaauuugcagccggaagaaagucucugacccugaaccuaaucacagaaauggguaggcuuccaacauucaugacucagaagacuagagacgcacuggacaacuuagcagugcugcacacggcugaggcagguggaagggcguacaaucaugcucucagugaacugccggagacccuggagacacugcuuuuacugacacuucuggcuacagucacgggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuauguugucauagccauccucacagugguggccgcaaccauggcaaacgagauggguuuccuagaaaaaacgaagaaagaucuuggauuaggaagcaucgcaacccagcaacccgagagcaacauccuggacauagaucuacgccccgcaucagcauggacgcuguaugccguggcuacaacauuuguuacaccaaugcugagacauagcauugagaauuccucagugaacguaucccuaacagccauagccaaccaagcaacaguguuaaugggucuagggaaaggauggccauugucaaagauggacaucggaguuccccuucucgccauuggaugcuacucacaagucaaucccauaacucucacagcagcucuucucuuauugguagcgcauuaugccauuauagggccaggacuucaagcaaaagcaaccagagaagcucagaaaagagcagcggcgggcaucaugaaaaacccaaccgucgauggaauaacagugauugaucuagauccaauaccuuaugauccaaaguuugaaaagcaguugggacaaguaaugcuccuaguccucugcgugacucaaguauugaugaugaggacuacaugggcucugugugaggccuuaaccuuagcuaccgggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccugacaaaaggaggaccaggacacgaagaacccauccccaugucaacauauggguggaaucuagugcgucuucaaaguggaguugacguuuucuucaucccgcccgaaaagugugacacauugcugugugacauaggggagucaucaccaaauccuacaguggaagcaggacgaacacucagaguccuuaauuuaguagaaaauugguugaacaacaacacucaauuuuguauaaaaguccucaacccauauaugcccucaguuauagaaaaaauggaaacacugcaaaggaaauauggaggagccuuagugagaaauccacucucacggaacuccacacaugagauguacuggguauccaacgcuuccgggaacauagugucaucagugaacaugauuucaaggauguugaucaacagauuuacaaugagacacaagaaagccacuuacgagccggauguugaccucggaagcggaacccguaacauuggaauugaaagugagauaccaaaucuagacauaauugggaaaagaauagaaaaaauaaagcaagagcaugaaacaucauggcacuacgaccaagaccacccauacaaaacgugggcauaccauggcagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaagcuccaucuugaaggaaagugugaaacauguguguacaacaugaugggaaaaagagaaaagaagcuaggggaauucggcaaggcaaaaggcagcagagccauaugguacauguggcuuggagcucgcuuucuggaguuugaagcccuaggauuccuaaaugaagaucacugguucuccagagagaacucccugaguggaguggaaggagaagggcugcacaagcuagguuacauucuaagagacgugagcaagaaagagggaggagccauguaugccgaugacacagcaggaugggacacaagaaucacacuagaagaccuaaaaaaugaagaaaugguaacaaaccacauggaaggagaacacaagaaacuagccgaggccauuuucaaacuaacguaccaaaacaagguggugcgugugcaaagaccaacaccaagaggcacaguaauggacaucauaucgagaagagaccaaagagguagugggcaaguugguaccuauggacucaauacuuucaccaauauggaagcccaauugaucagacagauggagggagaaggaguuuuuaaaaacauucagcaccugacagucacagaagaaauugccgugcaaaacugguuagcaagagugggacgcgaaagguuaucaagaauggccaucaguggagaugauuguguugugaaaccuuuagaugacagguucgcaagcgcuuugacagcucuaaaugacaugggaaagauuagaaaagacauacaacaaugggaaccuucaagaggauggaacgauuggacacaagugcccuucugcucacaccauuuccaugagcuaaucaugaaggauggucguguacuuguuguuccaugcagaaaccaagaugaacugauuggcagagcccgaaucucccaaggagcaggguggucuuugcgggagacggcuuguuuggggaagucuuacgcccaaauguggagcuugauguauuuccacagacgcgaccucagguuggcggcaaaugccauuugcucggcagugccaucacauuggguuccaacaagucgaacaaccugguccauacacgccaaacaugaauggaugacaacggaagacaugcugacagucuggaauaggguguggauucaggaaaacccauggauggaagacaaaaccccaguagaaucaugggaggaaaucccauacuuggggaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 6719 - RNA, 9876 nt, Artificial Sequence
  derived and/or modified CDS sequence (wt) from DENV-2__GQ868543__SS-prME
ucugcaggcaugaucauuaugcugauuccaacagugauggcguuccaucuaaccacacguaacggagaaccacacaugaucgucgguauacaggagaaagggaaaagucuucuguucaaaacagaggauggugugaacaugugcacccucauggcuauggaccuuggugaauugugugaagacacaaucacguacaaguguccucuucucaggcagaaugagccagaagacauagacuguuggugcaacuccacguccacguggguaaccuaugggacuuguaccacuacgggagaacauagaagagaaaaaagaucaguggcacucguuccacaugugggaaugggacuggagacgcgaaccgaaacauggaugucaucagaaggggcuuggaaacaugcccagagaauugaaacuuggauccugagacauccaggcuucaccauaauggcagcaauccuggcauacaccauagggacgacacauuuccagagagcccugauuuucauccuacugacagcugucgcuccuucaaugacgaugcguugcauaggaauaucaaauagagacuuuguagaagggguuucaggaggaaguuggguugacauagucuuagaacauggaagcugugugacgacgauggcaaaaaacaaaccaacauuggauuucgaacugauaaaaacggaagccaaacagccugccacccuaagaaaguacugcauagaagcaaagcuaaccaacacaacaacagaaucccguugcccaacacaaggggaacccagccuaaaagaagagcaggauaagagguucgucugcaaacacuccaugguagacagaggauggggaaauggauguggauuauuuggaaagggaggcauugugaccugugcuauguucacaugcaaaaagaacauggaagggaaaaucgugcaaccagaaaacuuggaauacaccauugugguaacaccucacucaggggaagagcaugcggucggaaaugacacaggaaaacacggcaaggaaaucaaaguaacaccacagaguuccaucacagaagcagaauugacagguuauggcaccgucacgauggagugcucuccgagaacaggccucgacuucaaugagaugguguugcugcagauggaaaauaaagcuuggcuggugcauaggcaaugguuccuagaccugccauuaccauggcugcccggagcggauaaacaagggucaaauuggauacagaaagaaacauuggucacuuucaaaaauccccaugcgaagaaacaggauguuguuguuuuaggaucccaagaaggggccaugcauacagcacucacaggagccacagaaauccaaaugucgucaggaaacuugcucuucacuggacaucucaagugcaggcugagaauggacaagcuacagcucaaaggaaugucauacucuaugugcacaggaaaguuuaaaguugugaaggaaauagcagaaacacaacauggaacgauaguuaucagagugcaauaugaaggggacggcucuccauguaaaaucccuuuugagauaauggauuuggaaaaaagauaugucuuaggccgccugaucacagucaacccaauuguaacagaaaaagauagcccagucaacauagaagcagaaccuccauucggagacagcuacaucaucauaggaguagagccgggacaacugaagcucaacugguucaagaaaggaaguucuaucggccaaauguuugagacaacgaugagaggggcgaagagaauggccauuuugggugacacagccugggacuucggaucccugggaggaauguuuacaucuauaggaaaagcucuccaccaagucuuuggagcaaucuauggagcugccuucagugggguuucauggacuaugaaaauccucauaggagucauuaucacauggauaggaaugaacucacgcagcaccucacugucugugucacuaguauuggugggaauugugacacuguauuugggagucauggugcaggccgauagugguugcguugugagcuggaaaaacaaagaacugaaauguggcagugggauuuucaucacagacaacgugcacacauggacagaacaauacaaguuccaaccagaauccccuucaaaacuagcuucagcuauccagaaagcucaagaagagggaauuugugggauccgcucaguaacaagauuggagaaccuaauguggaaacaaauaacaccagaauugaaucacauucuagcagaaaaugaggugaaguuaacuaucaugacaggagacaucaaaggaaucaugcaggcaggaaaacgaucuuugcggccucagcccacugagcuaaaguauucauggaaaacaugggguaaagcaaaaaugcucuccacagagucucauaaccaaaccuuucucauugauggccccgaaacggcagagugccccaacacaaauagagcuuggaacucguuggagguugaagacuacggcuuuggaguguucaccaccaauauauggcuaaaauugaaagaaaaacaggaugcauucugcgacucaaaacucaugucagcggccauaaaagacaacagagccguccaugccgacauggguuacuggauagaaagugcacucaaugacacauggaagauagagaaagccucuuucauugaaguaaaaaacugccacuggccaaaaucacacacccucuggagcaauggagugcuagaaagugagaugauaauuccaaagaaucucgcuggaccagugucucaacacaacuauagaccaggcuaccauacacaaauagcaggaccauggcaucuagguaagcuugagauggacuuugauuucugcgauggaaccacagugguggugacugaggacugcggaaauagaggacccucuuugagaacaacuacugccucuggaaaacucauaacagaauggugcugccgaucuugcacauuaccaccccuaagauacagaggugaggaugggugcugguacgggauggaaaucagaccauugaaagagaaagaagaaaauuugguuaacuccuuggucacagccggacaugggcagguugacaauuuuucauugggagucuugggaauggcauuguuccuggaggaaaugcuuaggacccgaguaggaacgaaacaugcaauacuacuaguugcaguuucuuuugugacauugaucacagggaacauguccuucaaagaccuaggaagaguggugguuaugguaggcgccaccaugacggaugacauagguaugggcgugacuuaucuugcccuacuagcagccuucaaaguuagaccaacuuuugcagcuggacuacucuugagaaagcugaccuccaaggaauugaugaugacuaccauaggaauuguacuccucucccaaagcacuauaccagagaccauucuugaauugacugaugcguuagccuuaggcaugaugguccuuaaaauaguaagaaacauggaaaaguaucaauuagcagugacuaucauggcuaucuugugcgucccaaacgcagugauauuacaaaaugcauggaaagugaguugcacaauacuggcagugguguccguuuccccacugcuuuugacauccucacagcaaaaaacggauuggauaccauuagcauugacaaucaagggucucaauccaacagccauuuuucuaacaacccucucaagaaccaacaagaaaaggagcuggccacuaaaugaggcuaucauggcagucggaauggugagcauuuuagccaguucccuccuaaaaaaugauauucccaugacaggaccacuaguggcuggagggcuccucacugugugcuacgugcucacuggacgaucggccgacuuggaacuggagagagcaaccgaugucaaaugggaagaccaggcagagauaucaggaagcaguccaauccugucaauaacaauaucagaagaugguagcaugucgauaaaaaaugaagaggaagaacaaacacugaccauacucauuagaacaggauugcuggugaucucaggacuuuuuccuguaucaauaccaaucacggcagcagcaugguaccugugggaagugaagaaacaacgggccggaguauugugggacguuccuucacccccacccaugggaaaggcugaacuggaagauggagccuacagaaucaagcaaaaagggauucuuggauauucucagaucggagcuggaguuuacaaagaaggaacauuccauacaauguggcaugucacacguggcgcuguucuaaugcauaaaggaaagaggauugaaccuucaugggcggacgucaaaaaagaucuaauaucauauggaggaggcuggaaguuagaaggagaauggaaggaaggagaagaaguccaggugcuggcacuggagccuggaaaaaauccaagagccguccaaacaaaaccuggucuuuucaaaaccaacaccggaacaauaggugccguaucucuggacuuuuccccuggaacgucaggaucuccaaucauugacaaaaaaggaaaaguugugggucuuuaugguaaugguguugucacaaggaguggagcauaugugagugcuauagcccaaacugaaaaaagcauugaagacaaccccgagaucgaagaugacauuuuccgaaagagaagacugaccaucauggaccuccacccaggagcgggaaagacgaaaagauaccuuccggccauagucagagaagcuauaaaacgggguuugagaacauuaauccuggcccccacuagaguuguggcagcugaaauggaggaagcucucagaggacuuccaauaagauaccaaaccccagccaucagagcugagcacacugggcgggaaauuguggaucuaaugugucaugccacauuuaccaugaggcugcuaucaccaguuagagugccaaacuacaacuugauuaucauggacgaagcccauuucacagacccagcaaguauagcagcuagaggauacaucucaacccgaguggagaugggugaggcagcugggauuuucaugacagccacucccccgggaaguagagauccauuuccucagagcaaugcaccaaucauagaugaagaaagagaaaucccugaacguucauggaauucuggacaugagugggucacggauuuuaaagggaagacuguuugguucguuccaagcauaaaagcaggaaaugauauagcagcuugccugagaaaaaauggaaagaaaguaauacaacuuaguaggaagacuuuugauucugaguaugucaagacuagaaccaaugauugggauuucgugguuacaacugacauuucagaaaugggugccaauuucaaagcugagaggguuauagaccccagacgcugcaugaaaccagucauacuaacagauggugaggagcgggugauucuggcaggaccuaugccagugacccacucuagugcagcacaaagaagagggagaauaggaagaaauccaaaaaaugaaaaugaccaguacauauacaugggagaaccucuggaaaaugaugaagacugugcacacuggaaagaagccaaaaugcuccuagauaacauuaacacaccagaaggaaucauucccaguauguuugaaccagagcgugaaaaaguggaugccauugauggcgaauaccgcuugagaggagaagcaaggaaaaccuuuguggacuuaaugaggagaggagaccuaccagucugguuggcuuacaaaguggcagcugaaggcaucaacuaugcagacagaaggugguguuuugauggaauuaagaacaaccaaauccuggaagaaaauguggaaguugaaaucuggacaaaagaaggggaaaggaagaaauugaaacccagaugguuggaugcuaggaucuacucugacccacuggcgcuaaaagaauucaaagaauuugcagccggaagaaagucucugacccugaaccuaaucacagaaauggguaggcuuccaacauucaugacucagaagacaagagacgcacuggacaaccuagcagugcugcacacggcugaagcagguggaagggcguacaaucaugcucucagugaacugccggagacucuagagacacugcucuuacugacacuucuggcuacagucacaggagggaucuuuuuauucuugaugagcgggaggggcauagggaagaugacccugggaaugugcugcauaaucacggcuagcauccuucuaugguacgcacaaauacagccacacuggauagcagcuucaauaauacuggaguuuuuucucauaguuuugcuuauuccagaaccagaaaaacagagaacaccccaagacaaccaauugaccuacguugucauagccauccucacagugguggccgcaaccauggcaaacgagauggguuuccuagaaaaaacgaagaaagaucuuggauuaggaagcauugcaacccagcaacccgagagcaacauccuggacauagaucuacgucccgcaucagcuuggacgcuguaugccguggcuacaacauucguuacaccaaugcugagacauagcauugagaauuccucagugaauguaucccuaacagcuauagccaaccaagcaacaguguuaaugggucuagggaaaggauggccauugucaaagauggacaucggaguuccccuucuugccauuggaugcuacucacaagucaaucccauaacucucacagcagcucuucucuuauugguagcgcauuaugccaucauagggccaggacuucaagcaaaagcaaccagagaagcccagaaaagagcagcggcgggcaucaugaaaaacccaaccgucgauggaauaacagugauugaucuagauccaauaccuuaugauccaaaguuugaaaagcaguugggacaaguaaugcuacuaauccucugcgugacucaaguauugaugaugaggacuacaugggcucugugugaggccuuaaccuuaguuacagggcccaucuccacacugugggaaggaaauccaggaagguucuggaacacuaccauugcggugucaauggcuaacaucuuuagagggaguuacuuggcuggagcuggacuucucuuuuccauuaugaagaacacaaccaacacaagaaggggaacuggcaacauaggagagacgcuuggagagaaauggaaaagccgauugaacgcacugggaaaaagugaauuccagaucuacaagaaaaguggaauccaggaaguggauagaaccuuagcaaaagaaggcaucaaaagaggagaaacggaccaucacgcugugucgcgaggcucagcaaaacugagaugguucguugagagaaacauggucacaccagaagggaaaguaguggaccucgguuguggcagaggaggcuggucauacuauuguggaggacuaaaaaacguaagagaagugaaaggccuaacaaaaggaggaccaggacacgaagaacccaucccuaugucaacauauggguggaaucuagugcgucuucagaguggaguugacguuuucuucaucccgccagaaaagugugacacauuguugugugacauaggggagucaucaccaaaucccacaguggaagcaggacgaacacucagaguccuuaauuuaguagaaaauugguugaacaacaacacucaauuuugcauaaaaguucucaacccauauaugcccucaguuauagaaaaaauggaagcacugcaaaggaaauauggaggagccuuagugagaaauccacucucacggaacuccacacaugagauguacuggguauccaaugcuucugggaacauagugucaucagugaacaugauuucaaggauguugaucaacagauucacaaugagacacaagaaagccacuuacgagccggauguugaccucggaagcggaacccguaacauuggaauugaaagugaaauaccaaaccuagacauaauugggaaaagaauagaaaaaauaaagcaagagcaugaaacaucauggcacuacgaccaagaccacccauacaaaacgugggcauaccaugguagcuaugaaacaaaacagacuggaucagcaucauccauggucaacggaguggucaggcugcugacaaaaccuugggacguccuccccacggugacacagauggcaaugacagacacgacuccauuuggacaacagcguguuuuuaaagaaaaaguggacacgagaacccaagaaccgaaagaaggcacgaagaaacuaaugaaaaucacagcagaguggcuguggaaagaauuagggaagaaaaagacaccuaggaugugcaccagagaagaauucacaagaaaggugagaagcaaugcagccuugggggccauauucacugaugagaacaaguggaagucggcacgugaggcuguugaagauaguagguuuugggagcugguugacaaggaaaggaaucuccaucuugaaggaaagugugagacauguguguacaacaugaugggaaaaagagaaaagaagcuaggggaauucggcaaggcaaaaggcagcagagccauaugguacauguggcuuggagcucgcuuccuggaguuugaagcccuaggauuccuaaaugaagaucacugguucuccagagagaacucccugaguggaguggaaggagaagggcugcacaagcuagguuacauucuaagagacgugagcaagaaagagggaggagccauguacgccgaugacacagcaggaugggacacaagaaucacacuagaagaccuaaaaaaugaagaaaugguaacaaaccacauggaaggagaacacaagaaauuagccgaggcuauuuucaaacuaacguaucaaaacaagguggugcgugugcaaagaccaacaccaagaggcacaguaauggacaucauaucgagaagagaccaaagagguagugggcaaguuggcaccuauggacucaauacuuucaccaauauggaagcccaauuaaucagacagauggagggagaaggagucuuuaaaaacauccagcaccugacagucacagaagaaguugccgugcaaaacugguuggcaagaguggggcgcgaaagguuaucaagaauggccaucaguggagaugauuguguugugaaaccuuuagaugacagguucgcaaacgcuuugacagcucuaaaugacaugggaaagauuagaaaagauauacaacaaugggaaccuucaaaaggauggaacgauuggacacaagugcccuucuguucacaccauuuccaugagcuaaucaugaaggauggucguguacuuguuguuccauguagaaaccaagaugaacugauuggcagagcccgaaucucccaaggagcaggguggucuuugcgggagacggccuguuuggggaagucuuacgcccaaauguggagcuugauguauuuccacaggcgcgaccucaggcuggcggcaaaugccauuugcucggcagugccaucacacuggguuccaacaagucgaacaaccugguccauacacgccaaacaugaauggaugacaacggaagacaugcugacagucuggaacaggguguggauucaagaaaacccauggauggaagacaaaaccccaguggaaucaugggaggaaaucccauacuugggaaaaagagaagaccaauggugcggcucauugauuggguuaacaagcagggccacaugggcaaagaacauccaagcagcaauaaaucaaguuagaucucuuauaggcaaugaggaauacacagauuacaugccauccaugaaaagauucagaagagaagaggaagaagcaggaguccugugguag

SEQ ID NO: 6720 - RNA, 9876 nt, Artificial Sequence
  derived and/or modified CDS sequence (wt) from DENV-2__EU482544__SS-prME
acagcaggcgugauuauuauguugauuccaacaguaauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaagugcccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcucugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaucugccguuaccauggcuacccggagcggacacacaaggaucaaauuggauacagaaagagacguuggucacuuucaaaaauccccacgcgaagaaacaggacgucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagagugcaauaugaaggggacggcucuccauguaagauuccuuuugagauaauggauuuggaaaaaagacacguccuaggucgccugauuacagugaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuuuuccacaaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucgcacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugugaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuacuaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacggguuugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagcuuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugccauagcccagaccgaaaaaagcauugaagacaauccagagaucgaagaugacauuuuccgaaagaaaagauugaccaucauggaucuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcucacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguaucgggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauugcugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucgucagugaacaugauuucaaggauguugauuaacagauucacaaugaagcacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagagaucgcugugcagaacugguuagcaagaguggggcgugaaagguuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuaggaaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6721 - RNA, 9876 nt, Artificial Sequence
  derived and/or modified CDS sequence (wt) from DENV-2__EU482545__SS-prME
acagcaggcgugauuguuauguugauuccaacagcgauggcguuucauuuaaccacacgcaauggagaaccacacaugaucguugguaggcaggagaaaggaaaaagucuucuguucaaaacagaggauggugucaacauguguacccucauggccauagaccuuggugaauugugugaagauacaaucacguacaaguguccucuccucagacaaaaugaaccagaagacauagauuguuggugcaacucuacguccacauggguaacuuaugggacauguaccacuacaggggaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgcugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaaguugaccaacacaacaacagaaucucguugcccaacacaaggggaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaaaucgugcagccagaaaauuuggaauacaccaucaugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcugguacacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcauacggcacucacaggggccacagaaauccagaugucaucaggaaacuuacuguucacaggacaucucaagugcaggcugagaauggacaaacuacagcucaaaggaaugucauacucuaugugcacaggaaaguuuaaaauugugaaggaaauagcagaaacacaacauggaacaauaguuaucagaguacaauaugaaggggaugguucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggauuuuggaucccugggaggaguguuuacaucuguaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuauaccugggagcuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgaucucugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaagucgaagacuaugguuuuggaguuuuuaccaccaauauauggcuaaaauugagagaaaaacaggauguauuuugugacucaaaacucaugucagcggccauuaaagacaacagagccguccaugcugauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaauuuugccgggccagugucacaacacaacuacagaccaggcuaccauacacaaacagcaggaccuuggcaucuaggcaagcuugagauggacuuugauuucugcgaaggaacuacagugguggugacugaggacuguggaaauagaggaccuucuuuaagaacgaccacugccucuggaaaacucauaacagaauggugcugccgauccuguacacuaccaccucuaagauacagaggugaggauggaugcugguacgggauggaaaucagaccauugaaagagaaagaggagaauuuggucaauuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggugcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcucuccuuucccaaagcaccauaccagagaccauucuugaacugacugaugcguuagccuugggcaugauggcucucaaaauagugaaaaauauggaaaaguaccaauuggcagugacuaucauggccauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacgacucuuucgagaaccagcaagaaaaggagcuggccgcuaaaugaagcuaucauggcaguugggauggugagcauuuuagccaguucucuccugaagaaugauauucccaugacagguccauuaguggcuggagggcuccuuacaguauguuacgugcucacuggacgaucggccgauuuggaacuagagagagcggccgauguaaaaugggaagaucaggcagaaauaucaggaagcagcccaauccugucaauaacaauaucagaagauggcagcaugucgauaagaaaugaagaggaagaacaaacacugaccauacucaucagaacgggauuguuggugaucucaggagucuuuccaguaucgauaccaguuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaguaucauauggaggaggcuggaagcuagaaggagaauggaaggaaggagaggaaguccaaguccuggcauuagaaccuggaaaaaauccaagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagaaaucgaagaugacauuuuccgaaagaaaagauugaccaucauggaccuucauccaggagcaggaaagacaaaaagauaccuuccagccauaguuagagaagccauaaaacguggcuugagaacauuaauccuggcucccaccagagucguggcagcugaaauggaggaagcucuuagaggacuuccaauaagauaccaaaccccagccaucagagccgagcacaccgggcgagagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugacgaagacugugcacauuggaaagaagccaaaaugcuccuagauaacaucaacacacccgaaggaaucauuccuaguauguucgaaccagagcgugaaaaaguggaugccauugauggugaauaccguuugagaggagaagcaaggaaaaccuucguggaccuaaugagaagaggggacuuaccagucugguuagccuacaaaguggcagcugaaggcaucaacuacgcagacagaaggugguguuuugauggaaucaagaauaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagccgggagaaaaucuuugacccugaauuuaaucacagaaauggguaggcuuccaacuuucaugacucagaaggcaagaaacgcacuggacaacuuggcugugcugcauacggcugaggcagguggaaaggcguauaaucaugcucucagugaacugccggagacccuggagacacugcuucuacuaacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggccacaacauuugucacaccaauguugaggcauagcauugaaaauuccucagugaaugucucccuaacagccauugcuaaccaagcuacagugcuaaugggucuugggaaaggauggccauugucaaagauggacaucggaguuccccuccucgccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuggcaaaagaaggcaucaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaaccuauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaauccauauaugcccucagucauagaaaaaauggaaacacuacaaaggaaauauggaggagccuuagugaggaauccacucucacgaaacuccacgcaugagauguacuggguaucuaaugccacugggaacauagugucaucagugaacaugauuucaaggauguugauuaacagauucacaaugaaacacaagaaagccaccuacgagccggauguugaccugggaaguggaacucgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugagacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacccaagaaccgaaggaaggcacaaagaaacugaugaaaauuacggcagaguggcuuuggaaagaacuaggaaagaaaaagacacccaggauguguaccagagaagaauucacaagaaaggugagaagcaaugcagccuugggggccauauucacugaugagaacaaauggaaaucggcacgugaggcuguugaagaugguagguuuugggagcugguugacagggaaagaaaucuccaucuugaaggaaagugugagacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaagcuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggagaaggaaucuucaaaagcauucagcaccugacagucacagaagaaaucgcuguacagaacuggcuagcaagaguggggcgugaaaggcuaucaagaauggccaucaguggagaugauuguguuguaaaacccauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccaaggagccggguggucuuugaaggagacggccuguuuggggaagucuuacgcccaaauguggacccugauguacuuccacagacgugaccucagacuggcggcaaaugccauuugcucggcagucccgucacauuggguuccaacgagucgaacaaccugguccauacacgcuaagcaugaauggaugacgacggaggacaugcuggcagucuggaacaggguguggauccaagaaaacccguggauggaagacaaaacuccaguggaaucaugggaagaagucccauacuuggggaaaagagaagaccaaugguguggcucauugauugggcuaacaagcagggcuaccugggcaaagaacauccaaacagcaauaaaccaagucagaucccuuauaggcaaugaggaauacacagacuacaugccauccaugaagagauucagaagggaagaggaagaggcagguguccugugguag

SEQ ID NO: 6722 - RNA, 9876 nt, Artificial Sequence
  derived and/or modified CDS sequence (wt) from DENV-2__EU482546__SS-prME
acagcaggcgugauuguuauguugauuccaacagugauggcguuccauuuaaccacacgcaauggagaaccacacaugaucguugguaggcaggagaaagggaaaagucuucuguucaaaacagaggaugguauuaacauguguacccucauggccauagaccuuggugaauugugugaagauacaaucacguacaaguguccucuccucaaacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauagggacgacacauuuccaaagggccuugauuuucaucuuacugacagcugucgcuccuucaaugacaaugcgcugcauaggaauaucaaauagagacuucguagaaggggucucaggaggaagcuggguugacauagucuuagaacauggaaguugugugacgacgauggcaaaaaacaaaccaacauuggauuuugaacugauaaaaacagaagccaaacaaccugccacuuuaaggaaguacuguauagaagcaaagcugaccaacacaacaacagaaucgcguugcccaacacaaggggaacccagucuaaaugaagagcaggacaaaagguucaucugcaaacauuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagaacacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuagggucucaagaaggggccaugcacacggcacucacaggggccacagaaauccagaugucaucaggaaacuuacuguucacaggacaucucaagugcaggcugagaauggacaagcuacagcucaaaggaaugucauacucuauguguacaggaaaauuuaaaauugugaaggaaauagcagaaacacaacauggaacaauaguuaucagaguacaauaugaaggagacgguucuccauguaagaucccuuuugagauaacagacuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggauuuuggaucccugggagggguguuuacaucuauaggaaaggcucuccaccaaguuuuuggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgguccuugcggccccagcccacugagcugaaguacucuuggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggaugcauuuugugacucaaaacucaugucagcggccauuaaagacaacagagccguccaugccgauauggguuauuggauagaaagugcacucaaugacacauggaagauggagaaagccucauucauugaaguuaaaagcugccacuggccaaagucacacacccucuggagcaauggaguauuagaaagugagaugauaauuccaaaaaauuuugccgggccagugucacaacacaaccacagaccagguuaccacacacaaacagcaggaccuuggcaucuagguaagcuugagauggacuuugauuucugcgaaggaaccacagugguggugacugaggacuguggaaauagaggacccucuuuaagaacgaccacugccuccggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugaugguuauggugggcgcuaccaugacggaugacauaggcaugggagugacuuaucuugcccuacuagcagcuuucaaaguuagaccaacuuuugcagcuggacuacucuugagaaaacugaccuccaaggaauuaaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucucucgagaaccagcaagaaaaggagcuggccgcuaaaugaagcuaucauggcagucgggauggugagcauuuuagccaguucucuccuaaagaaugauauucccaugacagguccacuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggacuguuggugaucucaggagucuuuccaguaucgauaccaauuacggcagcagcaugguaccugugggaagugaagaaacaacgggccggaguauugugggacgucccuucacccccaccagugggaaaagccgaacuggaagauggagccuauagaaucaagcaaagaggguuucuuggauauucucagauuggagccggaguuuacaaagaaggaacauuccauacaauguggcacgucacacguggugcuguucuuaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacacuggaaccauaggcgccguaucuuuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggacuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggauuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagccaaaaugcuccuagauaacaucaacacacccgaaggaaucauuccuaguauguuugaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaaugcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugaguggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacacagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuguugguagcacauuaugccauuauagggccaggacuucaagcaaaagcaaccagagaagcacagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggccuugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagauuuacaagaaaaguggaauccaggaaguggauagaacccuagcaaaagaaggcauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuggugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacauugcaaaggaaauauggaggagccuuggugaggaauccacucucacgaaacuccacgcaugaaauguacuggguaucuaaugccaccgguaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcgcguuuucaaagagaaaguggacacgagaacccaagaaccgaaggaaggcacaaagaaacugaugaaaauuacggcagaguggcuuuggaaagaacuaggaaagaaaaagacaccuaggguguguaccagagaagaauucacaagaaaagugagaagcaaugcagccuugggggccauuuucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacgugggcaaaaaggaagggggagcaauguacgccgaugauacagcaggaugggacacaagaaucacacuagaagauuuaaagaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcaguggacaagucggcaccuauggccuuaauacuuuuaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuagggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaagucaagucagaucucuuauaggcaaugaggaauacacagacuacaugccauccaugaagagauucagaagggaagaggaagaggcagguguccugugguag

SEQ ID NO: 6723 - RNA, 9876 nt, Artificial Sequence
  derived and/or modified CDS sequence (wt) from DENV-2__EU482550__SS-prME
acagcaggcgugauuauuauguugauuccaacagcaauggcauuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcucuguuccuggaagaaaugcucaggacccgaguaggaacgaaacaugcaauacugcuaguggcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggauuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuaccguguguuacgugcucacuggacgaucggccgauuuggaacuggagagagcugccgauguaaaaugggaagaucaggcagaaauaucaggaagcaguccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguccugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggacugggaagcauuauaacccaggaaucugagagcaacauccuggacauagauuuacguccugcaucagcauggacgcuguaugccguggccacaacauuuguuacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccuugguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccugggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcggacaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaagccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacucuaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6724 - RNA, 9876 nt, Artificial Sequence
  derived and/or modified CDS sequence (wt) from DENV-2__EU482551__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugggguuaacaugugcacccucauggccauagaccuuggugaauugugugaagauacaaucacguacaaguguccccuccucaggcaaaaugaaccagaagacauagauuguuggugcaacuccacguccacauggguaacuuauggaacauguaccaccacaggagaacacagaagggaaaaaagaucaguggcacucguuccacaugugggcaugggacuggagacacgaacugaaacauggaugucaucagaaggggccuggaaacacguucagagaauugaaaccuggaucuugagacauccaggcuuuaccacaauggcagcaauccuggcauacaccauaggaacgacacauuuccaaaggguccugaucuucauuuuacugacagccgucgcuccuucaaugacaaugcguugcauaggaauaucaaauagagacuucguagaagggguuucaggaggaaguugggucgacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaagggggcauuguaaccugugcuauguucacaugcaaaaagaacauggaaggaaaaguugugcugccagaaaaucuggaauacaccaucgugauaacaccucacucaggagaagagcacgcuguaggcaaugauacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaacuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugaucacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcccuccaccaaguuuucggagcaaucuauggggcugcuuuuaguggggucucauggacuaugaaaauccucauaggaguuaucaucacauggauaggaaugaauucacguagcaccucacugucugugucacuaguauuggugggaaucgugacacuguacuuggggguuauggugcaggcugacacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucacuggaaguugaagacuaugguuuuggaguuuuuucuaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcguggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggaguuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagaaagcugccgauguaaaaugggaagaucaggcagaaauaucaggaaguagcccaauccugucaauaacaauaucagaagauggcagcaugucgauaaaaaaugaagaggaagaacauacacugaccauacuaaucagaacgggauuacuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagcuaaugauugggauuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacuccagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaagguggugcuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagaguaacauucuggacauagaucuacguccugcaucagcauggacgcuguaugccguggccacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccugguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaacuuuagcaaaagaaggcaucaaaagaggggaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaccccacgauagaagcaggacgaacacuuagaguccucaacuuaguggaaaauugguugaacaauaacacucaauuuugcguaaagguucucaacccauacaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagcuacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagccuugggggccauauucacugaugagaacaaauggaaaucggcucgugaggcuguugaagauaguagguuuugggaacugguugacagggaaagaaaucuucaucuugaaggaaagugugaaacauguguguacaacaugauggggaaaagagagaagaaacuaggggaguucggcaaggcaaaagguagcagagccauaugguauauguggcuuggagcacguuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaucaaaacaagguggugcguguacaaagaccaacaccaagaggcacaguaauggacaucauaucgagaaaagaccaaagaggcagcgggcaagucggcaccuauggccuuaauacuuuuaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcaugcucgugguuccaugcagaaaccaagaugaacugauuggcagagcccgaauuucucagggagccggguggucuuugaaggagacggccuguuuggggaagucuuacgcccaaauguggaccuugauguacuuccacagacgugaccucagacuggcggcgaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6725 - RNA, 9876 nt, Artificial Sequence
  derived and/or modified CDS sequence (wt) from DENV-2__EU482552__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauucuacugacagccgucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacacuaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuacaggaaaggcucuccaccaaguuuucggagcaaucuauggggcagcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuugcggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucucugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugcgacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggauaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaauugcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcuaucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaauuaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguucaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccuuuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacuaccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggcugcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggaagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuccaucuugaggggaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaaggccaacaccaagaggcacaguaauggauaucauaucgagaaaagaccaaagaggcagcgggcaagucggcaccuauggccucaauacuuucaccaauauggaagcccaauuaauuagacagauggaaggagaaggaauuuucaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagccagaauuucccagggagccggguggucuuugaaggagacggccuguuuggggaagucuuacgcccaaauguggaccuugauguacuuccacagacgugaccucagacuagcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6726 - RNA, 9876 nt, Artificial Sequence
  derived and/or modified CDS sequence (wt) from DENV-2__EU482554__SS-prME
acagcaggcgugauuauuauguugauuccaacagcaauggcauuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggagcccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaacagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacugaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaacaaagaacugaaauguggcagcgggaucuucauuacagauaacgugcacacauggacagaacaauauaaguuccaaccagaauccccuucaaaacuagcuucagcuauccaaaaagcucaugaagaaggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggauuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcaguccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuauguagucauagccauccucacagugguggccgcaaccauggcaaaugagauggguuuccuggaaaaaaccaagaaagaccucggacugggaagcauuauaacccaggaaucugagagcaacauccuggacauagauuuacguccugcaucagcauggacgcuguaugccguggccacaacauuuguuacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccuugguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacuaaugaggauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcggacaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaagccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacucuaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6727 - RNA, 9876 nt, Artificial Sequence
  derived and/or modified CDS sequence (wt) from DENV-2__EU482556__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguccagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgucucucaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucgucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccguuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggacccuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugaggaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguggagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuggauaacaucaacacaccugaaggaaucauuccuagcauguucgaaccagagcgugaaaagguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacucuuaugacucagaaggcaagagacgcacuggacaacuuagcugugcugcauacggcugagguagguggaagggcuuacaaucaugcucucagugaacugccggagacccuggagacacugcuuuuacugacacuccuggcuacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagaugggcuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacgugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacucagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaaucgaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagaugugagcaagaaggaagggggagcaauguacgccgaugacacagcaggaugggacacgagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaauauggaagcccaauuaauuagacagauggagggagaaggaauuuuuaaaagcauucagcgccugacagucacagaagaaaucgcugugcagaacugguuaguaagaguggggcgugaaaggcuaucaagaauggccgucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccugucuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6728 - RNA, 9876 nt, Artificial Sequence
  derived and/or modified CDS sequence (wt) from DENV-2__EU529693__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugggguuaacaugugcacccucauggccauagaccuuggugaauugugugaagauacaaucacguacaaguguccccuccucaggcaaaaugaaccagaagacauagauuguuggugcaacucuacguccacauggguaacuuauggaacauguaccaccacaggagaacacagaagggaaaaaagaucaguggcacucguuccacaugugggcaugggacuggagacacgaacugaaacauggaugucaucagaaggggccuggaaacacguucagagaauugaaaccuggaucuugagacauccaggcuuuaccacaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguaggcaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacguuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggaaucgugacacuguacuuggggguuauggugcaggcugauacugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauuacuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccugguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggggaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcguaaagguucucaacccauacaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacguuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcguguacaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcugugcagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcaugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcgaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6729 - RNA, 9876 nt, Artificial Sequence
  derived and/or modified CDS sequence (wt) from DENV-2__EU482557__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuggaaaaaagacacguccuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagccuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauuguugugugacauaggggaaucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaaucacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcagguguccugugguag

SEQ ID NO: 6730 - RNA, 9876 nt, Artificial Sequence
  derived and/or modified CDS sequence (wt) from DENV-2__EU482560__SS-prME
acagcaggcgugauuguuauguugauuccaacagugauggcguuccauuugaccacacgcaauggagaaccacacaugaucguugguaggcaggagaaagggaaaagucuucuguucaaaacagaggaugguauuaacauguguacccucauggccauagaccuuggugaauugugugaagauacaaucacguacaagugcccucuccucaaacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauagggacgacacauuuccaaagggccuugauuuucaucuuacugacagcugucgcuccuucaaugacaaugcgcugcauaggaauaucaaacagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucguacagccagaaaauuuggaauacaccaucgugauaacaccucacucaggagaagaacacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuuuaaaaauccccacgcgaagaaacaggaugucguuguuuuagggucucaagaaggggccaugcacacggcacucacaggggccacagaaauccagaugucgucaggaaacuuacuguucacaggacaucucaagugcaggcugagaauggacaagcuacagcucaaaggaaugucauacucuauguguacaggaaaauuuaaaauugugaaggaaauagcagaaacacaacauggaacaauaguuaucagaguacaauaugaaggagacgguucuccauguaagaucccuuuugagauaacagauuuggaaaaaagacacgucuuaggucgccugauuacagucaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcaaagagaauggccauuuuaggugacacagccugggauuuuggaucccugggagggguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagcuauggugcaggcugauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagaaaaugagguaaaguugaccauuaugacaggagacauuaaaggaaucaugcaggcaggaaaacgauccuugcggccccagcccacugagcugaaguacucuuggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggaugcauuuugugacucaaaacucaugucagcggccauuaaagacaacagagccguccaugccgauauggguuauuggauagaaagugcacucaaugacacauggaagauggagaaagccucauucauugaaguuaaaagcugccacuggccaaagucacacacccucuggagcaauggaguauuagaaagugagaugauaauuccaaaaaauuuugccgggccagugucacaacacaaccacagaccagguuaccauacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucucuugugacauugauuacugggaacaugucuuuuagagaccuuggaagagugaugguuauggugggcgcuaccaugacggaugacauaggcaugggagugacuuaucuugcccuacuagcagcuuucaaaguuagaccaacuuuugcagcuggacuacucuugagaaaacugaccuccaaggaauuaaugauggccaccauaggaauugcacuccuuucccaaagcaccauaccagagaccauucuugaacugacugaugcguuagccuugggcaugaugguccucaaaauagugagaaauauggaaaaauaccaauuggcagugacuaucauggcuauuucgugcguuccaaaugcagugauauugcaaaacgcauggaaggugaguugcacaauauuggcagcgguguccguuucuccacugcuccuaacauccucacagcagaaagcggauuggauaccacuggcauugacgauaaaaggucucaauccaacagccauuuuucuaacaacucucucgagaaccagcaagaaaaggagcuggccgcuaaaugaagcuaucauggcagucgggauggugagcauuuuagccaguucucuccuaaagaaugauauucccaugacagguccacuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaagaaacaacgggcuggagucuugugggacgucccuucacccccaccaguggaaaaagccgaacuggaagauggagccuauagaaucaagcaaagaggguuucuuggauauucucagauuggagccggaguuuacaaagaaggaacauuccauacaauguggcacgucacacguggugcuguucuuaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaauccaagagccguccaaacgaaaccuggaauuuucaaaaccaacacuggaaccauaggcgccguaucuuuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaaaacaauccagagaucgaagaugacauuuuccgaaagaaaagauugaccaucauggaccuccauccaggagcaggaaagacaaaaagauaccuuccagccauaguuagagaagccauaaaacguggcuugagaacauugauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggacaugaaugggucacggacuuuaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugauuuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagccaaaaugcuccuagauaacaucaacacacccgaaggaaucauuccuaguauguuugaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaauguggaaguggaaauuuggacaaaagaaggggaaaggaaaaaauuaaaacccagaugguuggaugcuaggaucuauucugacccacuggcacuaaaagaauucaaggaauuugcagcuggaagaaaaucuuugacucugaaccuaaucacagaaauggguaggcuuccaacuuucaugacucagaaggcaagaaaugcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacacagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuguugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugcgaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagauuuacaagaaaaguggaauccaggaaguggauagaacccuagcaaaagaaggcauaaaaagaggagaaacggaccaccaugcugugucgcgagguucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccauccccaugucaacauauggguggaaucuggugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacauugcaaaggaaauauggaggagccuuggugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacagcguguuuucaaagagaaaguggacacgagaacccaagaaccgaaggaaggcacaaagaaacugaugaaaauuacggcagaguggcuuuggaaagaacuaggaaagaaaaagacaccuaggguguguaccagagaagaauucacaagaaaagugagaagcaaugcagccuugggggccauuuucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaggcuaggcuacauuuuaagagacguggguaagaaggaagggggagcaauguacgccgaugauacagcaggaugggacacaagaaucacacuagaagacuuaaagaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcaguggacaagucggcaccuauggccuuaauacuuucaccaauauggaagcccaauuaauuagacagauggagggagaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaaaucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaagucaagucagaucucuuauaggcaaugaggaauacacagacuacaugccauccaugaagagauucagaagggaagaggaagaggcagguguccugugguag

SEQ ID NO: 6731 - RNA, 9876 nt, Artificial Sequence
  derived and/or modified CDS sequence (wt) from DENV-2__EU482561__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucgcugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacuguuacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaauuguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucauuaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucauauucuaucagaaaaugagguaaaguugaccauuaugacaggagacaucaaaggaaucaugcaggcaggaaaacgaucuuugaggccccagcccacugagcugaaguacucauggaagacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaagauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguuguaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagcuuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauucugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugggguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaagggucauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacacagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagagaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaacuuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacacccaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuaaucaugaaagauggccgcgugcucguagucccauguagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcggucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6732 - RNA, 9876 nt, Artificial Sequence
  derived and/or modified CDS sequence (wt) from DENV-2__EU569703__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacgcaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaccuagguaagcucgagauggacuucgauuucugcgaaggaaccacagugguggugacugaggacuguggaaauagaggacccucuuuaagaacgaccacugccucuggaaaacuuauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagccagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6733 - RNA, 9876 nt, Artificial Sequence
  derived and/or modified CDS sequence (wt) from DENV-2__EU529694__SS-prME
acagcaggcguguuuauuauguugauuccaacagcaauggcguuccauuuaaccacacguaauggagaaccacacaugaucguugguaggcaagagaaagggaaaagucuucuguucaaaacagaggacgguguuaacauguguacccucauggccauggaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacauccauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaaugcggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggagaaguaccaauuggcagugacuaucauggcuaucucgugugucccaaaugcagugauauugcaaaacgcauggaaggugaguugcacaauauuggcagcgguguccguuucuccacugcucuugacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucagggagcagcccaauccugucaauaacaauaucagaggauggcagcaugucgauaaaaaaugaagaggaagaacaaacacugacuauacucaucagaacgggauuguuggugaucucaggagucuuuccaguaucgauaccaaucacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcggcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaaggaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaucucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacggcuauugcuaaccaagccacagugcuaaugggucuugggaaaggauggccauugucaaagauggacaucggaguuccccuccuugccauuggaugcuacucacaagucaacccuauaacucucacagcagcccuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugaucucaaggauguugauuaacagauucacaaugaaacacaagaaagccaccuacgagccagauguugacuuaggaagcggcacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6734 - RNA, 9876 nt, Artificial Sequence
  derived and/or modified CDS sequence (wt) from DENV-2__EU529695__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugcugggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccuaaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6735 - RNA, 9876 nt, Artificial Sequence
  derived and/or modified CDS sequence (wt) from DENV-2__EU482562__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggauggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugauacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugagcugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcuacuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaagcauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucauuuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6736 - RNA, 9876 nt, Artificial Sequence
  derived and/or modified CDS sequence (wt) from DENV-2__EU482565__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauugcuggugcaacucuacguccacauggguaacuuaugggacauguaccaccacaggagaacacagaagagaaaaaagaucaguggcacucguuccacauguaggcaugggacuggagacacgaacugaaacauggaugucaucagaaggggccuggaaacauguucagagaauugaaaccuggaucuugagacauccaggcuucaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacgcaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacaucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuccaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcagggaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgacguaaaaugggaagaucaggcagaaauaucaggaagcagcccaauccugucaauaacaauaucagaagauggcagcaugucgauaaaaaaugaagaggaagaacauacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacguuaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaagaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagccagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuugugguuacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugaguggaaaagguauagggaaaaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaccugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacguuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugagcuagucaugaaagauggccgcgugcucguggucccaugcagaaaccaagaugaacugauugguagagcccgaaucucucagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6737 - RNA, 9876 nt, Artificial Sequence
  derived and/or modified CDS sequence (wt) from DENV-2__EU529700__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauucuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguucuaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuugcuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggaccaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagaccauucuugaacugacugaugcguuagccuugggcaugaugguccucaaaauagugagaaaucuggaaaaguaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagacggaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuaugcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcauacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccgacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6738 - RNA, 9876 nt, Artificial Sequence
  derived and/or modified CDS sequence (wt) from DENV-2__EU529701__SS-prME
acagcaggcgugauuauuauguugauuccaacagcgauggcguuccaucuaaccacacguaauggagaaccacacaugaucguugguaggcaagagaaagggaaaagucuucuguucaaaacagaggauggugucaacauguguacccucauggccauggaccuuggugaauugugugaagauacaaucacguacaaguguccccuccucaggcaaaaugaaccagaagacauagacuguuggugcaacucuacguccacauggguaacuuauggaacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuugcugacagcugucgcuccuucaaugacaaugcguuguauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacccuaaggaaguacuguauagaagcaaagcugaccaauacaacaacagaaucucgcugcccaacacaaggggaacccagucuaaaugaagagcaggacaaaagguuccucugcaaacacuccaugguagacagaggauggggaaauggauguggauuauuuggaaagggaggcauugugaccugugcuauguuuacaugcaaaaagaacauggaaggaaaagucgugcagccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuguaggaaaggcucuccaccaaguuuucggagcaaucuauggggcugcuuuuaguggggucucauggacuaugaaaaucuucauaggagucaucaucacauggauaggaaugaauucacguagcaccucacugucugugucacuaguguuggugggagucgugacacuguaccugggagcuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagauuaugguuuuggaguuuuuaccaccaauauauggcuaaaauugagagaaaaacaggauguauuuugugacucaaaacucaugucagccgccauaaaagacaacagagccguccaugccgauauggguuauuggauagaaagugcacucaaugacacauggaagauggagaaagccucuuucauugaaguuaaaagcugucacuggccaaagucacacacccucuggaguaauggaguauuagaaagugagaugauaauuccaaaaaauuuugccgggccagugucacaacacaacuacagaccaggcuaccauacacaaacagcaggaccuuggcaucuagguaagcuagagauggacuuugauuucugcgaaggaacuacagugguggugacugaggacuguggaaauagaggacccucuuuaagaacgaccacugccucuggaaaacucauaacagaauggugcugcagauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuuccccacugcucuuaacauccucacagcagaaagcagauuggauaccacuggcauugacgauaaaaggccucaauccaacagccauuuuucuaacaacccuuucgagaaccagcaagaaaaggagcuggccgcuaaaugaagcuaucauggcagucgggaugguaagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccgguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaggaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaaaacaaaaagauaccuuccagccauaguuagagaagccauaaaacguggcuugagaacauuaauccuggcucccacuagagucguggcagcugaaauggaggaagcucuuagaggacuuccaauaagauaccaaaccccagcuaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacaucucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuagaaaaaauggaaagaaagugauacaacucaguagaaagacuuuugacucugaguauguuaagacuagagccaaugauugggacuuuguggucacaacugacauuucagaaaugggugccaacuucaaggcugagaggguuauagaccccagacgcuguaugaaaccaguuauacuaacagauggcgaagagcgggugaucuuggcaggaccuaugccagugacccacucuagugcagcgcaaagaagagggagaauaggaagaaauccaaaaaaugaaaaugaccaguauauauacaugggggaaccucuggaaaaugaugaagacugugcacauuggaaagaagcuaaaaugcuccuagacaacaucaacacaccugaaggaaucauuccuaguauguucgaaccagagcgugaaaaaguggaugccauugauggugaauaccguuuaagaggagaagcaaggaaaaccuuuguggaucuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacaaaagaaggggaaaggaagaaauuaaaacccagaugguuggaugcuagaaucuauucugacccacuggcacuaaaagaauucaaggaauuugcagcuggaagaaaaucuuugacccugaaccuaauuacagaaauggguaggcuuccaacuuucaugacucagaaggcaagagacgcacuggacaacuuagcugugcugcauacggcugaggcagguggaaaggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaagaaucugagagcaacauccuagacauagaucuacguccugcaucagcauggacgcuguaugccguggcuacaacauuugucacaccaaugcugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacucucacagcagcucuucuuuuguugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugagaagcaguuaggacaaguaaugcuccuaauccucugcgugacucaaguacuaaugaugaggacuacaugggcucugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugaucaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacgucauggcacuaugaccaagaccacccauacaaaacgugggcuuaccauggcaguuaugaaacaaaacaaacuggaucagcaucaucuauggugaacggaguggucaggcugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuagaauguguacuagagaagaauucacaagaaaggugagaagcaaugcagccuugggagccauauucacugaugagaacaaauggaagucggcacgugaggcuguugaagauaguagguucugggagcugguugacagggaaagaaaucuccaucuugaaggaaagugugaaacauguguguacaacaugaugggcaaaagagagaagaaacuaggggaguucggcaaggcaaaagguagcagagccauaugguacauguggcuuggagcacgcuucuuagaguuugaagcccuaggauucuugaaugaagaccacugguucuccagagggaacucucugaguggaguggaaggagaagggcugcauaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaacacuuucaccaacauggaagcccaauuaauuagacagauggaaggagaaggaaucuucaagagcauucagcacuugacaguuacagaagaaaucgcuguacagaacugguuagcaagagugggacgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6739 - RNA, 9876 nt, Artificial Sequence
  derived and/or modified CDS sequence (wt) from DENV-2__EU569704__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacuuccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguuccucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggaaucuuaggaauggcacuguuccuggaagaaaugcuuaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucuuaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggccacaacauuugucacaccaauguugagacauagcauugaaaauuccucagugaaugucucccuaacagcuauugcuaaccaagccacagugcuaaugggucuugggaaaggauggccauugucaaagauggacauuggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaucauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaagagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6740 - RNA, 9876 nt, Artificial Sequence
  derived and/or modified CDS sequence (wt) from DENV-2__EU482568__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguuccucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuagaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauauagaggugaggauggaugcugguacgggauggaaaucagaccauugaaagagaaagaggagaauuuggucaacuccuuggucacagccggacaugggcagauugacaacuuuucacuaggaaucuuaggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucuuaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguacuugugggaagugaagaaacaacgggcuggaguauugugggacgucccuucacccccaccaguggaaaaagccgaacuggaagauggagccuauagaaucaagcaaagagggauucuuggauauucucagauuggagccggaguuuacaaagaaggaacauuucauacaauguggcacgucacacguggugcuguucugaugcauagagggaagaggguugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagacugaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggccacaacauuugucacaccaauguugagacauagcauugaaaauuccucagugaaugucucccuaacagcuauugcuaaccaagccacagugcuaaugggucuugggaaaggauggccauugucaaagauggacauuggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacaaauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaaucucccagggagccggguggucuuugaaggagacggccuguuuggggaagucuuacgcccaaaugugggcccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6741 - RNA, 9876 nt, Artificial Sequence
  derived and/or modified CDS sequence (wt) from DENV-2__EU482569__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaagacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaauauaggagagacacuuggagaaaaauggaaaagccgauuaaacgcacugggaaaaaaugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucauaccagaagggaaggugguggaccucgguugcggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuuuaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaucuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6742 - RNA, 9876 nt, Artificial Sequence
  derived and/or modified CDS sequence (wt) from DENV-2__EU482570__SS-prME
acagcaggcgugauuauuauguugauuccaacagcgauggcguuccauuuaaccacacgcaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguuccucugcaaacacuccaugguagacagaggauggggaaauggauguggauuauuuggaaagggaggcauugugaccugugcuauguuuacaugcaaaaagaauauggaaggaaaagucgugcagccagaaaauuuggaauacaccaucgugauaacaccucacucaggagaagagcacgcuguaggcaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuaugguacaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaguaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuagaaagugagaugauaauuccaaaaaauuuugcugggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugaccuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaagguggguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcggaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaagugaaaaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaggaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacacugggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaaaggcguacaaucaugcucucagugaacugccggaaacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuggacauagaucuacguccugcaucagcauggacgcuguaugccguggccacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacacucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauugaugaugaggacuacaugggcucugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauacaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauucacaagaaaggugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggggcacgcuucuuagaguuugaagcccuaggauucuugaaugaagaucacugguucuccagagggaacucccugaguggaguggaaggagaagggcugcacaggcuaggcuacauuuuaaaagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaggucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggucaucaguggagaugauuguguuguaaagccuuuagaugacagauuugcaagugcuuuaacagcucuaaaugacaugggaaaaguuaggaaagauauacaacaaugggaacccucaagaggauggaacgauuggacacaagugccuuucuguucacaccauuuucaugaguuagucaugaaagauggucgcgugcucguagucccgugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauucaaacagcaauaaaucaagucagaucccuuauaggcaaugaagaauacacagacuacaugccauccaugaagagauuuagaagggaagaggaagaggcagguguccuaugguag

SEQ ID NO: 6743 - RNA, 9876 nt, Artificial Sequence
  derived and/or modified CDS sequence (wt) from DENV-2__EU482571__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagaacaggacaaaagguuccucugcaaacacuccaugguggacagaggauggggaaauggauguggauuauuuggaaagggaggcauugugaccugugcuauguuuacaugcaaaaagaacauggaaggaaaagucgugcugccagaaaauuuggaauauaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccuuuggaaaaugaugaagacugugcacauuggaaagaagcuaaaaugcuucuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcuguguugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauucucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaagggggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaacgcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagcguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6744 - RNA, 9876 nt, Artificial Sequence
  derived and/or modified CDS sequence (wt) from DENV-2__EU482572__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuacuauaauggcagcaauccuggcauauaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguuguguaacgacgauggcaaaaaauaaaccaacauuggauuuugaacuaauaaaaacagaagccaaacaaccugccacucuaaggaaguacuguauagaagcaaagcugaccaauacaacaacagaaucucguugcccaacacaaggggaacccagucuaaaugaagagcaggacaaaagguuccucugcaaacacuccaugguagacagaggauggggaaauggauguggauuauuuggaaagggaggcauugugaccugugcuauguuuacaugcaaaaagaacauggaaggaaaagucgugcagccagaaaaucuggaauacaccaucgugauaacaccccacucaggagaagagcacgcuguaggcaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccaucuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuaugguacaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaguaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcugccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuagaaagugagaugauaauuccaaaaaauuuugcugggccagugucacaacacaacuacagaccaggcuaccauacacaaacagcaggaccuuggcaucuagguaagcuugagauggacuuugauuucugcgaaggaacuacagugguggugacuggggacuguggaaauagaggacccucuuuaagaacgaccaccgccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugaccuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagugguguccguuucuccacugcuuuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcggaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccuuugggaagugaaaaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggaucgaaccaucaugggcagacgucaagaaagacuuaauaucauauggaggaggcuggaagcuagaaggagaauggaaggaaggagaggaaguccaaguccuggcauuggaaccuggaaaaaauccaagagccguccaaacaaaaccuggacuuuucaaaacuaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcuccuacuagagucguggcagcugaaauggaggaagcucuuagaggacuuccaauaagauaccaaaccccagccaucagagccgagcacacugggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaaaggcguacaaucaugcucucagugaacugccggaaacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcaucacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacacucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguaaugaugaugaggacuacaugggcucugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaagagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauacaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuagggagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaagcaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauucacaagaaaggugagaagcaaugcagccuugggggccauauucacugaugagaacaaauggaaaucggcacgugaggcuguugaagauaguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggggcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggucaucaguggagaugauuguguuguaaagccuuuagaugacagauuugcaagugcuuuaacagcucuaaaugacaugggaaaagucaggaaagauauacaacaaugggaaccuucaagaggauggaacgauuggacacaagugccuuucuguucacaccauuuucaugaguuagucaugaaagauggucgcgugcucguagucccgugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauucaaacagcaauaaaucaagucagaucccuuauaggcaaugaggaauacacagacuacaugccauccaugaagagauuuagaagggaagaggaagaggcagguguccugugguag

SEQ ID NO: 6745 - RNA, 9876 nt, Artificial Sequence
  derived and/or modified CDS sequence (wt) from DENV-2__EU482573__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguuccucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggggcuauggugcaggcugauagugguugcguugugagcuggaaaaauaaagaacugaaauguggcagcgggaucuucauuacagacaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgagcuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaaaacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaggggaaggugguggaccucgguugcggcagagggggcuggucauacuauugugggggacuaaagaauguaagagaagucaaaggccugacaaaaggaggaccaggacacgaagaacccauccccaugucaacauauggguggaaucuggugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauacaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6746 - RNA, 9876 nt, Artificial Sequence
  derived and/or modified CDS sequence (wt) from DENV-2__EU482574__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguuccucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcauauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggggccauggugcaggcugauagugguugcguugugagcuggaaaaauaaagaacugaaauguggcagcgggaucuucauuacagacaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgagcuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaaaacuuuugacucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggccacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaggggaaggugguggaccucgguugcggcagagggggcuggucauacuauugugggggacuaaagaauguaagagaagucaaaggccugacaaaaggaggaccaggacacgaagaacccauccccaugucaacauauggguggaaucuggugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauacaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaaaguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauccagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccaucugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6747 - RNA, 9876 nt, Artificial Sequence
  derived and/or modified CDS sequence (wt) from DENV-2__EU482575__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacgcagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguuccucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggagccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcccaugaagagggcauuugcggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccaguaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuuuaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacucugaguaugucaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccauugauggugaauaccguuugagaggagaagcaaggaaaaccuuuguagaccuaaugagaagaggggacuuaccagucugguuggcuuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguauaaucaugcucucagugaacugccggagacccuggagacacugcuuuuacugacacuccuggccacagucacaggaggaaucuucuuauucuuaaugagcggaaaagguauagggaaaaugacccugggaauguguugcauaaucacggcuagcauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccuuaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccuuagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauagguaaugaggaauacacagacuacaugccauccaugaagagauucagaagggaagaggaagaggcugguguccugugguag

SEQ ID NO: 6748 - RNA, 9876 nt, Artificial Sequence
  derived and/or modified CDS sequence (wt) from DENV-2__EU482578__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguaugggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaacuaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuagguaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagaugugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccucaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuuaaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuugggaaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6749 - RNA, 9876 nt, Artificial Sequence
  derived and/or modified CDS sequence (wt) from DENV-2__EU482580__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauggaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuugcugacagcugucgcuccuucaaugacaaugcguuguauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacaaccugccacccuaaggaaguacuguauagaagcaaagcugaccaauacaacaacagaaucucgcugcccaacacaaggggaacccagucuaaaugaagagcaggacaaaagguuccucugcaaacacuccaugguagacagaggauggggaaauggauguggauuauuuggaaagggaggcauugugaccugugcuauguuuacauguaaaaagaacauggaaggaaaagucgugcagccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauugguuacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucauuauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaaucuucauaggagucaucaucacauggauaggaaugaauucacguagcaccucacugucugugucacuaguguuggugggagucgugacacuguaccugggagcuauggugcaggcugauagugguugcguugugagcuggaaaaauaaagaacugaaauguggcagcgggaucuucaucacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagauuaugguuuuggaguuuuuaccaccaauauauggcuaaaauugagagaaaaacaggauguauuuugugacucaaaacucaugucagccgccauaaaagacaacagagccguccaugccgauauggguuauuggauagaaagugcacucaaugacacauggaagauggagaaagccucuuucauugaaguuaaaagcugucacuggccaaagucacacacccucuggagcaauggaguauuagaaagugagaugauaauuccaaaaaauuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugcagauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuuccccacugcucuuaacauccucacagcagaaagcggauuggauaccacuggcauugacgauaaaaggucucaauccaacagccauuuuucuaacaacccuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccgguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaggaaggagaggaaguccaaguccuggcauuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagcuaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacaucucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucaguagaaagacuuuugacucugaguauguuaagacuagagccaaugauugggacuuuguggucacaacugacauuucagaaaugggugccaacuucaaggcugagaggguuauagaccccagacgcugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguauauauacaugggggaaccucuggaaaaugaugaagacugugcacauuggaaagaagcuaaaaugcuccuagacaacaucaacacaccugaaggaaucauuccuaguauguucgaaccagagcgugaaaagguggaugccauugauggugaauaccguuuaagaggagaagcaaggaaaaccuuuguggaucuaaugagaagaggggacuuaccagucugguuggccuacagaguggcagcugaaggcaucaacuacgcagacagaaggugguguuuugauggaaucaagaacaaccaaauacuggaagaaaacguggaaguggaaaucuggacaaaagaaggggaaaggaagaaauuaaaacccagaugguuggaugcuagaaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaaaggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaagaaucugagagcaacauccuggacauagaucuacguccugcaucagcauggacgcuguaugccguggcuacaacauuugucacaccaaugcugagacauagcauugaaaauuccucagugaaugucucccuaacagccauugcuaaccaagccacagugcuaaugggucuugggaaaggauggccauugucaaagauggacaucggaguuccccuccuugccauuggaugcuacucacaagucaacccuauaacucucacagcagcucuucuuuuguugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugagaagcaguuaggacaaguaaugcuccuaauccucugcgugacucaaguacuaaugaugaggacuacaugggcucugugugaggcucuaaccuuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaucuagacauaauaggaaagagaauagagaaaauaaagcaagagcaugaaacgucauggcacuaugaccaagaccacccauacaaaacgugggcuuaccauggcaguuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuagaauguguacuagagaagaauucacaagaaaggugagaagcaaugcagccuugggagccauauucacugaugagaacaaauggaagucggcacgugaggcuguugaagauaguagguuuugggagcugguugacagggaaagaaaucuccaucuugaaggaaagugugaaacauguguguacaacaugaugggcaaaagagagaagaaacuaggggaguucggcaaggcaaaagguagcagagccauaugguacauguggcuuggagcacgcuucuuagaguuugaagcccuaggauucuugaaugaagaccacugguucuccagagggaacucccugaguggaguggaaggagaagggcugcauaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaacuaacguaccaaaacaagguggugcgugugcaaagaccaacaccaagaggcacaguaauggauaucauaucgagaagagaccaaagaggcagugggcaagucggcaccuauggccuuaacacuuucaccaacauggaagcccaauuaauuagacagauggaaggagaaggaaucuucaagagcauucagcacuugacaguuacagaagaaaucgcuguacagaacugguuagcaagagugggacgugaaaggcuaucaagaauggccaucaguggagaugauuguguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguccugugguag

SEQ ID NO: 6750 - RNA, 9876 nt, Artificial Sequence
  derived and/or modified CDS sequence (wt) from DENV-2__EU482581__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuuuaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacaggaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacuuuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcuacuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacuaugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6751 - RNA, 9876 nt, Artificial Sequence
  derived and/or modified CDS sequence (wt) from DENV-2__EU482582__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgaaccauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcuguuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcuacuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuagcauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcacuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaacagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6752 - RNA, 9876 nt, Artificial Sequence
  derived and/or modified CDS sequence (wt) from DENV-2__EU482583__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguagacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaaccacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaauaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaagcugaccauuaugacaggagacauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaggacaacagagccguccaugccgauauggguuauuggauagaaagugcacucaaugacacauggaagauggagaaagccucuuucauugaaguuaaaagcugccacuggccaaagucacacacucucuggagcaauggaguauuggaaagugagaugauaauuccaaaaaauuuugcugggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacagaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgacuuggaacuggagagagcugccgauguaaaaugggaagaucaggcagaaauaucaggaagcagcccaauccugucaauaacaauaucagaagauggcagcaugucgauaaaaaaugaagaggaagaacaaacacugacuauacucaucagaacgggauuguuggugaucucaggagucuuuccaguaucgauaccaaucacggcagcagcaugguauuugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccugggaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugacgcugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucuuagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguagccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcccagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacauuuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugaucaacagauucacaaugaaacacaagaaagccaccuacgagccagauguugaucuaggaagcggaacccgcaacauuggaauugaaagugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacguugucccuauggugacacagauggcaaugacagacacgacuccauuuggacaacaacgcguuuucaaagagaaaguggacacgagaacccaagaaccgaaggaaggcacaaagaaauugaugaaaauuacggcagaauggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacguuucuuagaguuugaagcccuaggauucuugaaugaagaucacugguucuccagagggaacucccugaguggaguggaaggagaagggcugcacagacuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguauuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauuaauugggcuaacaagcagggcuaccugggcuaagaacauccaaacagcaauaaaucaagucagaucccuuauaggcaaugaggaauacacagacuacaugccaucuaugaagagauucagaagggaagaggaagaggccgguguccugugguag

SEQ ID NO: 6753 - RNA, 9876 nt, Artificial Sequence
  derived and/or modified CDS sequence (wt) from DENV-2__EU482585__SS-prME
acagcaggcgugauuauuauguugauuccaacagcgauagcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggaggcauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugguaauuccaaaaaauuuugccggaccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcaguugggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacaaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagaaaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagaugggcuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaguaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagaaaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggaaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaaaucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6754 - RNA, 9876 nt, Artificial Sequence
  derived and/or modified CDS sequence (wt) from DENV-2__EU482587__SS-prME
acagcaggcgugauuauuauguugauuccaacagcgauggcguuccauuuaaccacacguaauggagaaccacacaugaucguugguaggcaagagaaggggaaaagucuucuguucaaaacagaggaugguguuaacauguguacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaaaggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaaguagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggcuaugcacacggcacucacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccuaauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugaguuggaaaaguagagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagagucucacaaucggaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguguuggaaagugagaugauaauuccaaaaaauuuugccgggccagugucacaacacaacuacagaccaggcuaccacacacaaacagcaggaccuuggcaucuagguaagcuugagauggacuuugauuucugcgaagguaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuugguaaacuccuugguuacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaguggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuauaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacguuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugagauagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccggcguccugugguag

SEQ ID NO: 6755 - RNA, 9876 nt, Artificial Sequence
  derived and/or modified CDS sequence (wt) from DENV-2__EU482588__SS-prME
acagcaggugugauuauuauguugauuccaacagcgauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacaggagagaaaaaagaucaguggcacucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaaggucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucguuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagauauuaaaggaaucaugcaggcaggaaaacgaucuuugaggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguuguacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacguuacacguggugcuguucugaugcauagagggaagaggauugaaccaucaugggcagacgucaagaaagaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagccgaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaucugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuagaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacccucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaauacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgaaagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccaugguagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauucuugaaugaagaccacugguucuccagagggaacucccugaguggaguggaaggagaagggcugcacaggcuaggcuacaucuuaagagacgugagcaagaaggaagggggagcaauguacgccgaugauacagcagggugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6756 - RNA, 9876 nt, Artificial Sequence
  derived and/or modified CDS sequence (wt) from DENV-2__EU569705__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucguuccacauguggguaugggacuggagacacgaacugaaacauggaugucaucggaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucagugacaagauuggagaaucugauguggaaacaaauaacaccagaauugaaucacauucuaucagaaaacgagguaaaguugaccauuaugacaggagacaucaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggauuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauagcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccggaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugauuaacagauucacaaugaaacacaagaaagccaccuacgagccagauguugacuuaggaagcggaacccgcaacauuguaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaacgaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauugugucguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6757 - RNA, 9876 nt, Artificial Sequence
  derived and/or modified CDS sequence (wt) from DENV-2__EU482589__SS-prME
acagcaggcgugauuauuauguugauuccaacagcgauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaaguguccccuccucagacaaaaugaaccagaagacauagauuguuggugcaacucuacguccacauggguaacuuaugggacauguaccaccacaggagaacacagaagagaaaaaagaucaguggcacucguuccacauguggguaugggacuagagacacgaacugaaacauggaugucaucagaaggggccuggaaacauguucagagaauugaaaccuggauccugagacauccaggcuuuaccauaauggcagcaauccuggcauacaccauaggaacaacacauuuccaaagggccuugauuuucauccuacugacagcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacagaagcagaacugacaggcuauggcacugucacgauggagugcucuccgagaaugggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggacgucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcuccccauguaagaucccuuuugagauaauggauuuggaaaaaagacacgucuuaggucgccugauuacaguuaacccaaucguaacagaaaaagauagcccagucaacauagaagcagaacccccauucggagacagcuacauuaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaaaacauggggaaaggcgaaaaugcucuccacagaaucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuagccgggccagugucacaacacaauuacagaccaggcuaccacacacaaacagcaggaccuuggcaucuagguaagcuugagauggacuuugauuucugugaaggaaccacagugguggugacugaggacuguggaaauagaggacccucuuuaagaacgaccacugccucuggaaaacucguaacagaauggugcugucgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaagccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccagguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauacgugagugcuauagcccagaccgaaaaaagcauugaagacaauccagagaucgaagaugacauuuuccgaaagaaaagauugaccaucauggaccuccauccaggagcaggaaagacaaaaagauaucuuccagccauaguuagagaagccauaaaacguggcuugagaacauuaauccuggcucccacuagagucguggcagcugaaauggaggaagcucuuagaggacuuccaauaagauaccaaaccccagccauuagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuagaaaaaauggaaagaaagugauacaacucaguaggaagacuuuugauucugaguauguuaagacuagagccaaugauugggacuuuguggucacaacugacauuucagaaaugggugccaacuucaaggcugagaggguuauagaccccagacguugcaugaaaccaguuauacuaacagauggcgaagagcgggugaucuuggcaggacccaugccagugacccacucuagugcagcgcaaagaagagggagaauaggaagaaauccaaaaaaugaaaaugaccaguacauauauaugggggaaccccuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaauccuugacccugaaccuaaucacagaaauggguaggcuuccaacuuucaugacucagaaggcaagaaacgcacuggacaauuuagcugugcugcauacggcugaggcagguggaagggcguacaaucaugcucucagugaacugccggagacccuggagacacugcuuuuacugacacuccuggccacagucacaggaggaaucuuuuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucucuaacagcuauugcuaaccaagccacagugcuaaugggucuugggaaaggauggccauugucaaagauggacaucggaguuccccuccuugccauuggaugcuacucacaagucaacccuauaacccucacagcagcccuucuuuuauugguagcacauuaugccauuauagggccaggacuucaagcaaaagcaaccagagaagcucagaaaagagcagcagcagguaucaugaaaaacccaacaguugauggaauaacagugauugaccuagaaccaauacccuacgauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacuggggaaaagugaauuucagaucuacaagaaaaguggaauccaggaaguggauagaaccuuagcaaaagaaggcaucaaaagaggagaaacggaccaccaugcugugucgcgaggcucagcaaaacugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaauaugauuucaaggauguugauuaacagauucacaaugaaacacaagaaagccaccuacgagccagauguugaccuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggauacgagaacucaagaaccgaaggaaggcacaaagaaacugaugaaaauuacggcagaguggcuuuggaaagaacuaggaaaggaaaagacacccaggauguguaccagagaagaauuuacaagaaaggugagaagcaaugcagccuugggggccauauucacugaugagaacaaauggaaaucggcacgcgaggcuguugaagauaguagguuuugggagcugauugacagggaaagaaaucuccaucuugaaggaaagugugaaacauguguguacaacaugaugggaaaaagagagaagaaacuaggggaguucgguaaggcaaaagguagcagagccauaugguacauguggcuuggagcacgcuucuuagaguuugaagcccuaggauucuugaaugaagaucacugguucuccagagagaacucccugaguggaguggaaggagaggggcugcacaggcuaggcuacauuuuaagagacgugagcaagaaggaagggggagcaauguacgccgaugauacagcagguugggacacaagaaucacacuagaagacuuaaaaaaugaagaaaugguaacaaaccacaugaaaggagaacacaagaaacuagcagaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagccacagaagaaaucgcuguacagaacugguuagcaagaguggggcgugaaaggcuaucaagaauggccaucaguggagaugauuguguuguaaaaccuuuggaugacagauuugcaagugccuuaacagcccuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaaaucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccggugucuugugguag

SEQ ID NO: 6758 - RNA, 9876 nt, Artificial Sequence
  derived and/or modified CDS sequence (wt) from DENV-2__EU569706__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguugggucgacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguucuaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuugcuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggaccaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagaccauucuugaacugacugaugcguuagccuugggcaugaugguccucaaaauagugagaaaucuggaaaaguaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuauaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagacggaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuaugcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucggugaaugucuccuuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaggggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaaacaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccauaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacgcaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6759 - RNA, 9876 nt, Artificial Sequence
  derived and/or modified CDS sequence (wt) from DENV-2__EU569707__SS-prME
acagcaggcgugauuauuauguugauuccaacagcaauggcguuccauuuaaccacacguaauggagaaccacacaugaucguugguaggcaagaaaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacuuguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggacuuugaacugauaaaaacagaagccaaacagccugccacucuaaggaaguacuguguagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcggauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccagucaacauagaagcagaaccuccauucggagacagcuacaucaucauaggaguagaaccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaauacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacggaauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggagaaguaccaauuggcagugacuaucauggcuaucucgugugucccaaaugcagugauauugcaaaacgcauggaaggugaguugcacaauauuggcagcgguguccguuucuccacugcucuuaacauccucacagcagaaagcggauuggauaccacuggcauugacgauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgauguaaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcggcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagaaaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcuaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccagucauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuggauaacaucaacacaccugaaggaaucauuccuaguauguucgaaccagagcgugaaaagguggaugccaucgauggugaauaccgcuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaaggaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaucucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacggcuauugcuaaccaagccacaguacuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaacuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguaucuaaugcuaccgggaacauagugucaucagugaacaugauuucaaggauguugauuaacagauucacaaugaaacacaagaaagccaccuacgagccagauguugacuuaggaagcggaacccgcaacauuggaauugaaagugagauaccaaaccuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaaaacaccuaggauguguaccagagaagaauuuacaagaaaggugagaagcaaugcagccuugggggccauauucacugaugagaacaaauggaaaucggcacgugaggcuguugaagauaguagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuuaaaaaaugaagaaauggugacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggccgcgugcucguagucccaugcagaaaccaagaugaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6760 - RNA, 9876 nt, Artificial Sequence
  derived and/or modified CDS sequence (wt) from DENV-2__EU660399__SS-prME
acagcaggcgugauuauuauguugauuccaacagcgauggcguuccauuuaaccacacguaauggagaaccacacaugaucguugguaggcaagagaaagggaaaagucuucuguucaaaacagaggacgguguuaacauguguacccucauggccauagaccuuggugaauugugugaagauacaaucacguacaaguguccccuccucaggcaaaaugaaccagaagacauagauuguuggugcaacucuacguccacauggguaacauaugggacauguaccaccacaggagaacacagaagagaaaaaagaucaguggcacucgucccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacggcugucgcuccuucaaugacaaugcguugcauaggaauaucaaauagagacuucguagaagggguuucaggaggaagcuggguugacauagucuuagaacauggaaguugugugacgacgauggcaaaaaauaaaccaacauuggauuuugaacugauaaaaacagaagccaaacagccugccacucuaaggaaguacuguauagaagcaaagcugaccaauacaacaacagaaucucguugcccaacacaaggggaacccagucuaaaugaagagcaggacaaaagguucgucugcaaacacuccaugguggacagaggauggggaaauggauguggauuauuuggaaagggaggcauugugaccugugcuauguuuacaugcaaaaagaacauggaaggaaaagucgugcugccagaaaauuuggaauacaccaucgugauaacaccucacucaggagaagagcacgcuguagguaaugacacaggaaaacauggcaaggaaaucaaaauaacaccacagaguuccaucacggaagcagaacugacaggcuauggcacugucacgauggagugcucuccgagaacaggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguagcagaaaaagauagcccaguuaacauagaagcagaaccuccauucggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuuuggagcaaucuauggggcugcuuuuaguggggucucauggacuaugaaaauccucauaggagucaucaucacauggauaggaaugaauucacguagcaccucacugucugugucacuaguauuggugggagucgugacacuguaccugggagcuauggugcaggcugauagugguugcguugugagcuggaaaaguaaagaacugaaauguggcagcgggaucuucaucacggauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugaggccccagcccacugagcugaaguacucauggaagacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuaccaccaauauauggcuaaaacugagagaaaaacaggauguauuuugugacucaaaacucaugucagcggcuauaaaagacaacagagccguccaugccgauauggguuauuggauagaaagugcacucaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccacacacaaacagcaggaccuuggcaucuagguaagcuugagauggacuuugauuucugcgaaggaaccacagugguggugacugaggacuguggaaauagaggacccucuuuaagaacgaccacugccucuggaaaacucauaacagaauggugcugucgauccugcacacuaccaccucuaagauacagaggugaggauggaugcugguacgggauggaaaucagaccauugaaagagaaagaggaaaauuuggucaacuccuuggucacagccggacaugggcagauugacaacuuuucacuaggagucuugggaauggcacuguuccuggaagaaaugcucaggacccgaguaggaacgaagcaugcaaugcugcuaguugcaguauccuuugugacauugauuacugggaacauguccuuuagagaccugggaagagugaugguuauggugggcgcuaccaugacggaugacauagguaugggaauaacuuaucuugcucuacuagcagcuuucaaagucagaccaacuuuugcagcuggacuacucuugagaaaacugaccuccaaggaauuaaugauggccaccauaggaaucgcacuccuuucccaaagcaccauaccagagaccauucuugaacugacugacgcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccacugcuuuuaacauccucacagcagaaagcggauuggauaccacuggcauugacgauaaaaggucucaauccaacagccauuuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuacgugcucacuggacgaucggccgauuuggaacuggagagagcugccgaugugaaaugggaagaucaggcagaaauaucaggaagcagcccaauccugucaauaacaauaucagaggauggcagcaugucgauaaaaaaugaagaggaagaacaaacacugacuauacucaucagaacgggauuguuggugaucucaggagucuuuccaguaucgauaccaauuacggcagcagcaugguacuugugggaagugaagaaacaacgggcuggaguauugugggacgucccuucacccccaccagugggaaaggccgaacuggaagauggagccuauagaaucaagcaaagagggauucuuggauacucucagauuggagccggaguuuacaaagaaggaacauuccauacaauguggcacgucacacguggugcuguucugaugcauagagggaagaggauugaaccaucaugggcagacgucaagaaggaccuaauaucauauggaggaggcuggaagcuagaaggagaauggaaggaaggagaggaaguccaaguccuggcguuggaaccuggaaaaaauccaagagccguccaaacgaaaccuggacuuuucaaaaccaacaccggaaccauaggcgccguaucucuggacuuuuccccuggaacgucaggaucuccaauugucgauagacaaggaaaaguugugggucuuuacggcaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaaaauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggaugaagcccacuucacagacccagcaaguauagcagcuagaggauacauuucaacucgaguagagaugggugaagcagcugggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguaugguuuguuccaaguauaaaagcaggaaaugacauagcagcuugucuuaggaaaaauggaaagaaagugauacaacucaguaggaagacuuuugauucugaguauguuaagacuagagccaaugauugggacuuuguggucacaacugacauuucagaaaugggugccaacuucaaggcugaaaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucuggaaaaugaugaagacugugcacauuggaaagaagcuaaaaugcuucuagauaacaucaacacaccugaaggaaucauuccuaguauguucgaaccagagcgugaaaagguggaugccaucgauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaaccuagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuucucauaguuuugcucauuccagaaccagaaaaacagagaaccccccaagacaaccaauugaccuacguugucauagccauccucacagugguggccgcaaccauggcaaacgagauggguuuccuggagaaaaccaagaaagaccucggauugggaagcauugcaacccaggaaucugagagcaacauccuggacauagaucuacguccugcaucagcauggacgcuguaugccguggcuacaacauuugucacaccaauguugagacauagcauugaaaauuccucagugaaugucucccuaacagcuauugcuaaccaagccacagugcuaaugggucuugggaaaggauggccauugucaaagauggacaucggaguuccccuccuugccauuggaugcuacucacaagucaacccuauaacucucacagcagcccuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggaccacaugggcucugugugaggcucuaacccuagcgaccgggcccaucuccacacugugggaaggaaauccagggagguuuuggaacaccaccauugcagugucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccaugcugugucgcgaggcucagcaaaauugagaugguucgucgagagaaauauggucacaccagaagggaaggugguggaccucgguuguggcagaggggguuggucauacuauugugggggacuaaagaauguaagagaagucaaaggccugacaaaaggaggaccaggacacgaagaacccauccccaugucaacauauggguggaaccuagugcgucugcaaaguggaguugacguuuucuucaccccgccagaaaagugugauacauuguugugugacauaggggagucgucaccaaaucccacgauagaagcaggacgaacacuuagaguccucaauuuaguggaaaauugguugaacaauaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauagugucaucagugaacaugauuucaaggauguugaucaacagauucacaaugaaacacaagaaagccaccuacgagccagauguugacuuaggaagcggaacccgcaacauuggaauugaaagugagauaccaaaccuagauauaauaggaaagagaauagagaaaauaaagcaagagcaugaaacaucauggcacuaugaccaagaccacccauacaaaacgugggcuuaccauggcagcuacgaaacaaaacaaacuggaucagcaucaucuauggugaacggaguggucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugaaaaucacggcagaguggcucuggaaagaacuaggaaagaaaaagacaccuaggauguguaccagagaagaauuuacaagaaaggugagaagcaaugcagccuugggggccauauucacugaugagaacaaauggaaaucggcacgugaggcuguugaagauagcagguuuugggagcugauugacagggaaagaaaucuccaucuugaaggaaagugugaaacaugcguguacaacaugaugggaaaaagagagaagaaacuaggggaguucggcaaggcaaaagguagcagagccauaugguacauguggcuuggagcacgcuuccuagaguuugaagcccuaggauucuugaaugaagaucacugguuuuccagagggaacucccugaguggaguggaaggagaagggcugcacaggcuaggcuacauuuuaagagacgugagcaagaaggaagggggagcaauguacgccgaugauacagcaggaugggacacaagaaucacacuagaagacuugaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuacggccuuaauacuuucaccaacauggaagcccaauuaauuagacagauggagggagaaggaauuuucaaaagcauucagcaccugacagucacagaagaaaucgcuguacagaacugguuagcaagaguggggcgugaaaggcuaucaagaauggccaucaguggagaugauuguguuguaaaaccuuuggaugacagauuugcaagugcuuugacagcucuaaaugacaugggaaaaguuaggaaagauauacaacaaugggaaccuucaagaggauggaaugauuggacacaagugccuuucuguucacaccauuuucaugaguuagucaugaaagauggccgcgugcucguagucccaugcagaaaccaagacgaacugauugguagagcccgaaucucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaauaggguguggauccaggaaaacccguggauggaagacaaaacuccaguggaaucaugggaagaagucccauacuuggggaaaagagaagaccaauggugcgguucauugauugggcuaacaagcagggccaccugggcaaagaacauccaaacagcaauaaaucaagucagaucccuuauaggcaaugaggaauacacagacuacaugccauccaugaagagauucagaagggaagaggaagaggccgguguccugugguag

SEQ ID NO: 6761 - RNA, 9876 nt, Artificial Sequence
  derived and/or modified CDS sequence (wt) from DENV-2__EU569708__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacauguggguaugggacuggagacacgaacugaaacauggaugucaucagaaggggccuggaaacauguucagagaauugaaaccuggaucuugaggcauccaggcuuugccauaauggcagcaaucuuggcauacaccauaggaacgacacauuuccaaagggccuugauuuucaucuuacugacagcugucgcuccuucaaugacaaugcguugcauaggaauaucaaauagagacuuuguagaagggguuucagguggaagcuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguuuacaugcaaaaagaacauggaaggaaaagucgugcugccggaaaaucuggaauacaccaucgugauaacaccucacucaggagaagagcacgcuguaggcaaugacacaggaaaacauggcaaggaaaucaaaauaacaccacagaguuccaucacagaagcagaacugacaggcuauggcacugucacgauggagugcucuccgagaacgggccucgacuucaaugagauggugcugcugcagauggaagagaaagcuuggcuggugcacaggcaaugguuccuagaccugccguuaccauggcuacccggagcggacacacaaggaucaaauuggauacagaaagagacauuggucacuuucaaaaauccccacgcgaagaaacaggaugucguaguuuuaggaucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaauuguaacagaaaaagauagcccagucaacauagaagcagaaccuccauuuggagacagcuacaucaucauaggaguagagccgggacaauugaaacucaauugguuuaagaagggaaguuccaucggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacgcagcaccucacugucugugucacuaguauuggugggagucgugacacuguaccugggagcuauggugcaggcugauagugguugcguugugagcuggaaaaacaaagaacugaaauguggcagcgggaucuucauuacagauaacgugcacacauggacggaacaauauaaguuccaaccagaauccccuucaaaacuagcuucagccauccaaaaagcucaugaagagggcauuuguggaauccgcucaguaacaagauuggagaaucugauguggaaacaaauaacaccagaauugaaucacauccuaucagaaaaugagguaaaguugaccauuauuacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugagacagcagaaugccccaacacaaacagagcuuggaacucacuggaaguugaagacuaugguuuuggaguuuuuaccaccaauauauggcuaaaacugagagaaaaacaggauguauuuugugacucaaaacucaugucagcggccauaaaagacaacagagccguccaugccgauauggguuauuggauagaaagugcacuuaaugacacauggaagauggagaaagccucuuucauugaaguuaaaagcugccacuggccaaagucacacacccucuggagcaauggaguauuggaaagugagaugauaauuccaaaaaauuuugccgggccagugucacaacacaacuacagaccaggcuaccauacacaaacagcaggaccuuggcaucuagguaagcuugagauggacuucgauuucugcgaaggaaccacagugguggugacugaggacuguggaaauagaggacccucuuuaagaacgaccacugccucuggaaaacuuauaacagaauggugcugccgaucuugcacacuaccaccucuaagauauagaggugaggauggaugcugguacgggauggaaaucagaccauuaaaagagaaagaggagaauuuggucaacuccuuggucacggccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacauguccuuuagagaccugggaagagugaugguuauggugggcgcuaccaugacggaugacauagguaugggagugacuuaccuugcccuacuagcagcuuucaaaguuagaccaacuuucgcagcuggacuacucuugagaaaacugaccuccaaggaauuaaugauggccaccauaggaaucgcacuccuuucccaaagcaccauaccagagaccauucuugaacugacugaugcguuagccuugggcaugaugguccucaaaauaguuagaaacauggaaaaguaccaauuggcagugacuaucauggcuaucucgugugucccaaaugcagugauacugcuaaacgcauggaaggugaguugcacaauauuggcagcgguguccguuucuccauugcucuuaacauccucacagcagaaaacggauuggauaccacuggcauugacgauaaaaggucucaauccaacagccauuuuuuuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuccuuacuguguguuaugugcucacuggacgaucggccgauuuggaacuggagagagcugccgauguaaaaugggaagaucaggcagaaauaucaggaagcagcccaauccugucaguaacaauaucagaagauggcagcaugucgauaaaaaaugaagaggaagaacaaacacugaccauacucauuagaacgggauugcuggugaucucaggagucuuuccaguaucgauaccaauuacggcagcagcaugguaccugugggaagugaagaaacaacgggcuggaguauugugggacgucccuucacccccaccagugggaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaacaccggaacuauaggcgccguaucucuggacuuuuccccuggaacgucaggaucuccaauugucgacagaaaaggaaaaguugugggucuuuacggcaaugguguugucacaaggaguggagcauaugugagugcuauagcccagaccgaaaaaagcaucgaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauacuggcccccacuagaguuguggcagcugaaauggaggaagcucuuagaggacuuccaauaagauaccaaaccccagccaucagagcagagcacaccgggcgggagaucguggaccuaaugugucaugccacauuuacuaugaggcugcuaucaccagucagagugccaaauuacaaccugaucaucauggacgaagcccacuucacagauccagcaaguauagcagcuagaggauacauuucaacucgaguagaaaugggugaagcagcugggauuuucaugacagccacuccuccgggaaguagagacccauuuccucagagcaaugcaccaaucauggaugaggaaagagaaaucccugagcgcucguggaauucaggacaugaaugggucacggauuuuaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaggagcgggugaucuuggcaggaccuaugccagugacccacucuagugcagcacaaagaagagggagaauaggaagaaauccaaaaaacgaaaaugaccaguacauauacaugggggaaccucuggaaaaugaugaagacugugcacauuggaaagaagcuaaaaugcuccuagauaacaucaacacaccugaaggaaucauuccuaguauguucgaaccagagcgugaaaagguugaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugaggcagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguugcauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauucuucagugaaugucucccuaacagccauugcuaaccaagccacaguguuaaugggucuugggaaaggauggccauugucaaagauggacaucggaguuccccuccuugccauuggaugcuauucacaagucaacccuauaacucucacagcagcucuucuuuuauugguagcacauuaugccauuauaggaccaggacuucaagcaaaagcaaccagagaagcucagaaaagagcagcagcaggcaucaugaaaaacccaacagucgaugggauaacagugauugaccuagaaccaauacccuaugauccaaaauuugaaaagcaguuaggacaaguaaugcuccuaauccucugcgugacucaaguauuaaugaugaggacuacaugggcucugugugaggcucuaacccuagcgaccgggcccaucuccacacugugggaaggaaauccagggagguuuuggaauacuaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagucgauuaaacgcacugggaaaaagugaauuucagaucuacaagaaaaguggaauccaggaaguggauagaaccuuggcaaaagaaggcaucaaaagaggagaaacggaccaccacgcugugucgcgaggcucagcaaaauugagaugguucgucgagagaaauauggucacaccagaagggaaggugguggaccucgguugcggcagagggggcuggucauacuauugugggggacugaagaauguaagagaagucaaaggcuugacaaaaggaggaccaggacacgaagaacccauccccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaacaacacccaauuuugcauaaagguucucaacccauauaugcccucagucauagaaaaaauggaaacacuacaaaggaaauauggaggagccuuagugaggaauccacucucacgaaacuccacacaugagauguacuggguauccaaugcuaccgggaacauaguaucaucagugaacaugauuucaaggauguugauuaacagauucacaaugaaacacaagaaagccaccuacgagccagauguugacuuaggaagcggaacccgcaacauuggaauugaaagugagauaccaaaucuagacauaauaggaaagagaauagagagaauaaagcaagagcaugaaacaucauggcacuaugaccaagaccacccauacaaaacgugggcuuaccauggcagcuaugaaacaaaacaaacuggaucagcaucaucuauggugaacggaguggucagacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaaguaaugcagccuugggggccguauucacugaugagaacaaauggaaaucggcucgugaggcuguugaagauaguagguuuugggagcugguugacagggaaagaaaucuccaucuugaaggaaagugugaaacauguguguacaacaugaugggaaaaagagaaaagaaacuaggggaguucggcaaggcaaaaggcagcagagccauaugguacauguggcuuggagcacgcuucuuagaguuugaagcccuaggauucuugaaugaagaucacugguucuccagaaggaacucccugaguggaguggaaggagaaggguugcacaggcuaggcuacauuuuaagagacgugagcaagaaggaagggggagcgauguacgccgaugauacagcaggaugggacacaagaaucacacuagaagaccuaaaaaaugaagaaaugguaacaaaccacaugaaaggagaacacaagaaacuagccgaggccauauucaaauuaacguaccaaaauaagguggugcgugugcaaagaccaacaccaagaggcacaguaauggauauuauaucgagaagagaccaaagaggcagcgggcaagucggcaccuauggccuuaauacuuucaccaacauggaagcccaauuaauuagacagauggagggagaaggaaucuucaaaagcauucagcaccugacagucacagaagaaaucgcuguacagaacugguuagcaagaguggggcgugaaaggcuaucaagaauggccauuaguggagaugauuguguuguaaaaccuuuagaugacagauuugcaagugcuuuaacagcucuaaaugacaugggaaaaguuaggaaagauauacaacaaugggaaccuucaagaggauggaacgacuggacacaagugccuuucugcucacaccauuuucaugaguuagucaugaaagauggucgcgugcucguagucccaugcagaaaccaagaugaacugauugguagagcccgaauuucccagggagccggguggucuuugaaggagacggccuguuuggggaagucuuacgcccaaauguggacccugauguacuuccacagacgugaccuuagacuggcggcaaaugccauuugcucggcagucccgucacauuggguuccaacaagucgaacaacuugguccauacacgcuaagcaugaauggaugacgacggaagacaugcuggcagucuggaauaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccaaacagcaauaaaucaagucagaucccuuauaggcaaugaggaauacacagacuacaugccauccaugaagagauucagaagggaagaggaagaggcagguguacugugguag

SEQ ID NO: 6762 - RNA, 9876 nt, Artificial Sequence
  derived and/or modified CDS sequence (wt) from DENV-2__EU569709__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagaugucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaauggaguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacauuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucgugguuccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6763 - RNA, 9876 nt, Artificial Sequence
  derived and/or modified CDS sequence (wt) from DENV-2__EU596485__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccgcaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaacacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaagaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguucaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucauugucugugucacuaguauuggugggagucgugacacuguacuugggaguuauggugcaggcugauagcgguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagacucucacaaucagaccuuucuuauugauggcccugaaacagcagaaugccccaacacaaacagagcuuggaacucacuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuucucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgccaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuucuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagaugucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugacggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccgcagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcccuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuagggaagaaaaagacaccuaggauguguaccagagaagaauuugcaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaaggacugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6764 - RNA, 9876 nt, Artificial Sequence
  derived and/or modified CDS sequence (wt) from DENV-2__EU569710__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaauucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugacuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccauucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaagaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacaguggugguaacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaagagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugaucaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacacuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggaugaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugauuuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacugcaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6765 - RNA, 9876 nt, Artificial Sequence
  derived and/or modified CDS sequence (wt) from DENV-2__EU596486__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuacuauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauuaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccuugacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucggcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacuaacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcacagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcgggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaaugcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucaucccuauggugacacagauggcaaugacagacacgacuccauuuggacaacaacgcguuuucaaagagaaaguggacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcggacaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaagccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacauagacuacaugccauccaugaagagauucagaaaggaagaggaagaggcagguguccugugguag

SEQ ID NO: 6766 - RNA, 9876 nt, Artificial Sequence
  derived and/or modified CDS sequence (wt) from DENV-2__EU687212__SS-prME
acagcaggcgugauuguuauguugauuccaacagcgauggcguuccauuuaaccacacgcaauggagaaccacacaugaucguugguaggcaggagaaagggaaaagucuucuguucaaaacagaggauggugucaacauguguacccucauggccauagaccuuggugaauugugugaagauacaaucacguacaaguguccucuccucagacaaaaugaaccagaagacauagauuguuggugcaacucuacguccacauggguaacuuaugggacauguaccaccacaggagaacacagaagagaaaaaagaucaguggcgcucguuccacauguggguaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagcugucgcuccuucaaugacaaugcgaugcauaggaauaucaaauagagacuucguagaagggguuucaggaggaagcuggguugacauagucuuagaacauggaaguugugugacgacgauggcaaaaaacaaaccaacauuggauuuugaacugauaaaaacagaagccaaacaaccugccacucuaaggaaguacuguauagaagcaaagcugaccaacacaacaacagaaucgcguugcccaacacaaggagaacccagucuaaaugaagagcaggacaaaagguucaucugcaaacacuccaugguagacagaggauggggaaauggauguggauuauuuggaaagggaggcauugugaccugugcuauguuuacaugcaaaaagaacauggaaggaaaagucguacagccagaaaauuuggaauacaccaucgugauaacaccucacucaggagaagagcacgcuguagguaaugacacaggaaagcauggcaaggaaaucaaaauaacaccacagaguuccaucacagaagcagaacugacaggcuauggcacugucacgauggagugcucuccgagaacgggccucgacuucaaugagauggugcugcugcagauggaagacaaagcuuggcuggugcacaggcaaugguuccuagaccugccguuaccauggcuacccggagcggacacacaaggaucaaauuggauacagaaagagacauuggucacuuucaaaaauccccacgcuaagaaacaggaugucguuguuuuagggucucaagaaggggccaugcacacggcacucacaggggccacagaaauccagaugucaucaggaaacuuacuguucacaggacaucucaagugcaggcugagaauggacaaacuacagcucaaaggaaugucauacucuauguguacaggaaaguuuaaaaucgugaaagaaauagcagaaacacaacauggaacaauaguuaucagaguacaauaugaaggggacgguucuccauguaagaucccuuuugagauaacagauuuggaaaaaagacacgucuuaggacgccugauuacaguuaacccaaucauaacagaaaaagauagcccagucaacauagaagcagaaccuccauucggagacagcuacaucaucauaggaguagagccgggacaacugaaacucaauugguuuaagaagggaaguuccaucggccaaauguuugagacaacaaugagaggagcaaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacugucugugucgcuaguauuggugggagucgugacacuguaccugggagccauggugcaggcugauagugguugcguugugagcuggaaaaauaaagaacugaaauguggcagcgggaucuucaucacagauaacguacacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucauauucuaucagagaaugaaguaaaguugaccauuaugacaggagacauuaaaggaaucaugcaggcaggaaaacgauccuugcggccucagcccacugagcugaaguacucauggaaaacauggggaaaggcgaaaaugcucucuacagagucucacaaucagaccuuucuuauugauggcccugaaacagcagaaugccccaacacaaacagagcuuggaacucgcuggaaguugaagacuaugguuuuggaguuuuuaccaccaauauauggcuaaaauugagagaaaaacaggauguauuuugugacucaaaacucaugucagcggccauuaaagacaacagagccguccaugccgauauggguuauuggauagaaagugcacucaaugacacauggaagauggagaaagccuccuucauugaaguuaaaagcugccacuggccaaagucacacacccucuggagcaauggaguauuagaaagugagaugauaauuccaaaaaguuuugccgggccagugucacaacacaacuacagaccaggcuaccauacacaaacagcaggaccuuggcaucuagguaagcuugagauggacuuugauuucugcgaaggaacuacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcacuguuccuggaagaaaugcucaggacccgaguaggaacgaaacaugcaauacugcuaguugcaguaucuuuugugacauugauuacugggaacaugucuuuuagagaccugggaagagugauggucauggugggcgcuaccaugacggaugacauagguaugggagugacuuaucuugcccuacuagcagcuuucaaaguuagaccaacuuuugcagcuggacuacucuugagaaaacugaccuccaaggaauuaaugauggccaccauaggaaucgcacuccuuucccaaagcaccaugccagagaccauucuugaacugacugaugcguuagccuugggcaugaugguccucaaaauagugagaaauauggaaaaauaccaauuggcagugacuaucauggcuauuucgugugucccaaaugcagugauauugcaaaacgcauggaaggugaguugcacaauauuggcaacgguguccguuucuccacugcucuuaacauccucacagcagaaagcggauuggauaccacuggcauugacuauaaaaggucucaauccaacagccauuuuucuaacaacucuuucgagaaccagcaagaaaaggagcuggccgcuaaaugaagcuaucauggcagucgggauggugagcauuuuagccaguucucuccuaaagaaugauauuccuaugacagguccauuaguggcuggagggcuccuuaccguauguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauuguuggugaucucaggagucuuuccaguaucgauaccaauuacggcagcagcaugguaccugugggaaguaaagaaacaacgggcuggaguauugugggacgucccuucacccccaccaguggaaaaagccgaacuggaagauggagccuauagaaucaagcaaagagggauucuuggauauucucagauuggagccggaguuuacaaagaaggaacauuccauacaauguggcacgucacacguggugcuguucugaugcauagagggaagaggauugaaccaucaugggcagaugucaagaaagaccuaauaucauauggaggaggcuggaagcuagaaggagaauggaaggaaggagaggaaguccaaguccuggcauuggaaccuggaaaaaaucccagagccguccaaacgaaaccuggaauuuucaaaaccaacaccggaaccauaggcgccguaucucuggacuuuuccccuggaacgucaggaucuccaauugucgacagaaaaggaaaaguugugggucuuuacgguaaugguguugucacaaggaguggagcauauguaagugcuauagcccagaccgaaaaaagcauugaagacaauccagagaucgaagaugacauuuuccgaaagaaaagacugaccaucauggaccuccauccaggagcaggaaagacaaaaagauaccuuccagccauaguuagagaagccauaaaacguggcuugagaacauuaauccuggcucccacuagagucguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugauuaucauggacgaagcccacuucacagacccagcaagcauagcagcuagaggauacauuucaacucgaguagagaugggugaagcagccgggauuuucaugacagccacuccuccgggaaguagagacccauuuccucagagcaaugcaccaaucauggaugaggaaagagaaaucccugagcguucguggaauucaggacaugaaugggucacggauuuuaaagggaagacuguuugguuuguuccaaguauaaaagcaggaaaugacauagcagcuugucuuaggaaaaauggaaagaaagugauacaacucagcaggaagacuuuugacucugaguauguuaagacuagagccaaugauugggacuuuguggucacaacugacauuucagaaaugggugccaacuucaaggcugagaggguuauagacccuagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggggaaccucucgaaaaugaugaagacugugcacauuggaaagaagcuaaaaugcuccuagauaacaucaacacacccgaaggaaucauuccuaguauguucgaaccagagcgugaaaaaguggaugccauugauggugaauaccguuugagaggagaagcaaggaaaaccuuuguggaccuaaugagaagaggggacuuaccagucugguuggccuacaaaguggcagcugaaggcaucaacuacgcagacagaaagugguguuuugauggaauuaagaacaaccaaauacuggaagaaaacguggaaguggaaaucuggacaaaagaaggggaaaggaaaaaauuaaaacccagaugguuggaugcuaggaucuauucugacccacuggcacuaaaagaauucaaggaauuugcagcuggaagaaaaucuuugacccugaaccuaaucacagaaauggguaggcuuccaacuuucaugacucagaaggcaagaaacgcacuggacaacuuggcugugcugcauacggcugaggcagguggaagggcguacaaucaugcucucagugaacugccggagacccuggagacacugcuucuacugacacuccuggcaacagucacaggaggaaucuucuuauucuuaaugagcggaaaagguauagggaagaugacccugggaauguguugcauaaucacagcuagcauccuccuaugguaugcacagauacaaccacacuggauagcagcuucaauaauacuggaguuuuuucucauaguuuugcucauuccagaaccagaaaaacagagaacaccccaagacaaccaauugaccuacguugucauagccauccucacagugguggccgcaaccauggcaaacgagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagcuacagugcuaaugggucuugggaaaggauggccauugucaaagauggacaucggaguuccccuccuugccauuggaugcuacucacaagucaacccuauaacucucacagcagcucuucuuuuauugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaauccucugcgugacucaaguauuaaugaugaggacuacaugggcuuugugugaggcucuaacccuagcgaccgggcccauuuccacacugugggaaggaaauccagggagguuuuggaacaccaccauugcagugucaauggcuaacaucuuuagggggagcuacuuggccggagcuggacuucucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaacccuagcaaaagaaggcaucaaaagaggagaaacggaccaccaugcugugucacgaggaucagcaaaacugagaugguucgucgagagaaauauggucacaccggaagggaaggugguggaucucgguugcggcagagggggcuggucauacuauugugggggacuaaagaauguaagagaagucaaaggccuaacaaaaggaggaccaggacacgaagaacccguccccaugucaacauauggguggaaucuagugcgucugcaaagugggguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguccucaacccauauaugcccucagucauagaaaaaauggaaacacuacaaaggaaauauggaggagccuuagugaggaauccacucucacgaaacuccacgcaugaaauguacuggguaucuaaugccaccgggaacauagugucaucagugaacaugauuucaaggauguugauuaacagauucacaaugaaacacaagaaagccaccuacgagccagauguugaccuaggaaguggaacccgcaacauuggaauugaaagugagauaccaaaucuagacauaauaggaaagagaauagagaaaauaaagcaagagcaugaaacaucauggcauuaugaccaagaccacccauacaaaacgugggcuuaccauggcagcuaugaaacaaaacaaacuggaucagcaucaucuauggugaacggaguggucagacugcugacaaaaccuugggacgucgucccuauggugacacagauggcaaugacagacaccacuccauuuggacaacagcgcguuuucaaagagaaaguggacacgagaacucaagaaccgaaggaaggcacaaagaaacugaugaaaauuacggcagaguggcuuuggaaagaacuaggaaagaaaaagacaccuaggauguguaccagagaagaauucacaaaaaaagugagaagcaaugcagccuugggggccauauucacugaugagaacaaauggaaaucggcacgugaggcuguugaagaugguagguuuugggagcugguugacagggaaagaaaucuccaucuugaaggaaagugugaaacauguguguacaacaugaugggaaaaagagagaagaaacuaggggaguucggcaaggcaaaagguagcagagccauaugguacauguggcuuggagcacgcuucuuagaguuugaagcccuaggauuucugaaugaagaucacugguucuccagagggaacucccugaguggaguggaaggagaagggcugcacaggcuaggcuacauuuuaagagaagugggcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggauaucauaucgagaagagaccaaagaggcagugggcaagucggcaccuauggccuuaauacuuucaccaauauggaagcccaauuaauuagacagauggagggggaaggaaucuucaaaagcauucagcaccugacagccacagaagaaaucgcuguacagaacugguuagcaagaguggggcgugaaaggcuaucaagaauggccaucaguggagaugauuguguuguaaaaccuauagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguagucccaugcagaaaccaagaugaacugauuggcagagcccgaauuucccagggagccggguggucuuugaaggagacggccuguuuggggaagucuuacgcccaaauguggacccugauguacuuccauagacgugaccucagacuggcggcaaaugccauuugcucggcagucccgucacauuggguuccaacaagucgaacaaccugguccauacacgccaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggcuaccugggcaaagaacauccagacagcaauaaaucaagucagaucccuuauaggcaaugaggaauacacagacuacaugccauccaugaagagauucagaagggaagaggaagaggcagguguccugugguag

SEQ ID NO: 6767 - RNA, 9876 nt, Artificial Sequence
  derived and/or modified CDS sequence (wt) from DENV-2__EU660400__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugauuuucaucuuacugacaaccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggcuacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgguccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacgacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacugggcgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuagcauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggccacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcgaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguuguggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagggacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6768 - RNA, 9876 nt, Artificial Sequence
  derived and/or modified CDS sequence (wt) from DENV-2__EU569711__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauugcuggugcaacucuacguccacauggguaacuuaugggacauguaccaccacaggagaacacagaagagaaaaaagaucaguggcacucguuccacauguaggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuucaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacgcaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacaucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuucuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacguuaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagccagaggauauauuucaacucgaguagagaugggugaagcagccgggauuuucaugacagccacuccuccgggaaguagagacccauuuccucagagcaaugcaccaauuauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggauauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucucagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6769 - RNA, 9876 nt, Artificial Sequence
  derived and/or modified CDS sequence (wt) from DENV-2__EU569712__SS-prME
acagcaggcaugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagacuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuagaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccaguggaaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaauggaguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaaccgacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucacgcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaacuaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaucaggccacagugcuaaugggucuugggagaggauggccauugucaaagauggacaucggaguuccccuccuugcuauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguagacacgagaacccaagaaccgaaggaaggcacaaagaaacuaaugagaauuacggcagaguggcuuuggaaagaacuaggaaagaaaaagacaccuaggauguguaccagagaagaauuuacaagaaaagugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacauuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacggaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucgcauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6770 - RNA, 9876 nt, Artificial Sequence
  derived and/or modified CDS sequence (wt) from DENV-2__EU596487__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggcccugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguauuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccacacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacgggauugcuggugaucucaggagucuuuccaguaucgauaccaauuacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaaguuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaauuauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcaucacaacccaggaaucugagagcaacauucuggacauagaucuacguccugcaucagcauggacgcuguaugccguggcuacaacauuugucacaccaauguugagacauagcauugaaaauuccucagugaaugucuccuuaacagccauugcuaaccaagccacagugcuaaugggucuugggagaggauggccauugucaaagauggacauuggaguuccccuccuugccauuggaugcuauucacaagucaacccuauaacucucacagcagcucuucuucuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcuguaucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacugggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaaggaggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucucagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugaucgggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccuaugguag

SEQ ID NO: 6771 - RNA, 9876 nt, Artificial Sequence
  derived and/or modified CDS sequence (wt) from DENV-2__EU569713__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaaggggucucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguagugacacaggaaaacauggcaaggaaauuaaaauaacaccacagaguuccaucacagaagcagaacugacaggcuauggaacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugaggcaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggaacuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaauggaguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggauccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuacaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguagacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacauuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaaaaggcagguguccugugguag

SEQ ID NO: 6772 - RNA, 9876 nt, Artificial Sequence
  derived and/or modified CDS sequence (wt) from DENV-2__EU569714__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccgcaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaagaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguucaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagcgguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucacuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugacaacuucucacuaggagucuugggaauggcucuguuccuggaagaaaugcucaggacccgaguaggaacgaaacauguaauacugcuaguugcaguaucuuucgugacauugauuaccgggaacauguccuuuagagaccugggaagagugaugguuauggugggcgcuaccaugacagaugacauagguaugggagugacuuaccuugcccuacuagcagcuuucaaaguuagaccaacuuuugcagcuggacuacucuugagaaaacugaccuccaaggaacuaaugauggccaccauaggaaucgcacuucuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagugguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcuuacuggacgaucggccgauuuggaacuggagagagcugccgauguaaaaugggaagaccaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagaugucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuaggaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccgcagucacaggaggaaucuuccuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcccuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaagaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuagggaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcaccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuaggaaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6773 - RNA, 9876 nt, Artificial Sequence
  derived and/or modified CDS sequence (wt) from DENV-2__EU569715__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuagaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguauaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuggaagacuuaaaaaaugaagaaaugguaacaaaccacaugaaaggagaacacaagaaacuagccgaggccauauucaaauuaacguaccaaaacaagguggugcgugugcaaagaccaacaccaggaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6774 - RNA, 9876 nt, Artificial Sequence
  derived and/or modified CDS sequence (wt) from DENV-2__EU569716__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguuguccaacacaaggggaacccagucuaaaugaagagcaggacaaaagguucaucugcaaacacuccaugguagacagaggauggggaaauggauguggauuauuuggaaaaggaggcauugugaccugugcuauguucauaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaagaugucguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagauacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucucugggaggaguguuuacaucuauaggaaaggcucuucaccaaguuuucggagcaaucuauggggcugcuuuuaguggggucucauggacuaugaaaauccucauaggagucaucaucacauggauaggaaugaauucacguagcaccucacugucugugucacuaguauuggugggagucgugacacuguacuugggaguuauggugcaggcugauagugguugcguugugagcuggaaaaauaaagaauugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaccacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuagguaagcucgagauggacuucgauuucugcgaaggaaccacagugguggugaccgaggacuguggaaauagaggacccucuuuaagaacaacuacugccucuggaaaacucauaacagaauggugcugccgauccugcacacuaccaccucuaagauacagaggugaggauggaugcugguacgggauggaaaucagaccauugaaagagaaagaggagaauuuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaacugaccuccaaggagcuaaugauggccaccauaggaaucgcacuccuuucccaaagcaccauaccagagacuauucuugaacugacugaugcguuagccuugggcaugaugguccucaaaauagugagaaauauggaaaaguaccaauuggcagugacuaucauggcuaucuugugugucccaaaugcagugauauugcaaaacgcauggaaggugaguugcacaauauuggcagcgguguccguuucuccauugcucuuaacauccucacagcagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggaggacuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacaaacacugaccauacucaucagaacgggauugcuggugaucucaggagucuuuccaguaucgauaccaaucacggcagcagcaugguaccugugggaagugaaaaaacaacgggcuggaguauugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacgcguggugcuguucugaugcauagagggaagaggauugaaccaucaugggcagacgucaagaaagaccuaauaucauauggaggaggcuggaagcuagaaggagaauggaaagaaggagaggaaguccaaguccuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagcuauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacguuuacuaugaggcugcuaucaccagucagagugccaaauuacaaccugaucaucauggacgaagcccacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggauuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaauggguaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaguugaccuacguagucauagccauccuuacagugguggccgcaaccauggcaaaugagauggguuuccuggaaaaaaccaagaaagaccucggauugggaagcauuauaacccaggaaucugagagcaacauccuggacauagaucuacguccugcaucagcauggacgcuguaugccguggcuacaacauuugucacaccaauguugagacauagcaucgaaaauuccucagugaaugucucccuaacagccauugcuaaccaggccacagugcuaaugggucuugggagaggauggccauugucaaagauggacaucggaguuccccuccuugccauuggaugcuauucacaagucaacccuauaacucucacagcagcccuucuuuugcugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacccaaguauuaaugaugaggacuacaugggcucugugugaggcucuaaccuuagcgaccgggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaauauggucacaccagaagggaaggugguggaccucgguugcggcagagggggcuggucauacuauugugggggacuaaagaauguaagagaagucaaaggccugacaaaaggaggaccaggacacgaagaacccauucccaugucaacauauggguggaaucuagugcgucugcaaaguggaguugacguuuucuucaccccgccagaaaagugugauacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacuaaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauuccugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcggacaagucggcaccuauggccuuaauacuuucaccaacauggaagcccaauuaauuagacagauggagggagaaggaauuuuuaaaagcauucagcaccugacagucacagaagaaaucgcuguacagaacuggcuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuucaugaguuagucaugaaagauggucgcgugcucguggucccaugcagaagccaagaugaacugauugguagagcucgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccauggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6775 - RNA, 9876 nt, Artificial Sequence
  derived and/or modified CDS sequence (wt) from DENV-2__EU569717__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacgcaaggggaacccagucuaaaugaagagcaggacaaaagguucaucugcaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugagauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggaugucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuuggaguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaccuagguaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacguuaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagccagaggauacauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugcaaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaagggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggcuaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauuuugcauaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugguuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaagcaaacuggaucagcaucaucuauggugaacggaguugucagacugcugacaaaaccuugggacgucgucccuauggugacacagauggcaaugacagacacgacuccauuuggacaacaacgcguuuucaaagagaaaguggacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuucaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugagcuagucaugaaagauggucgcgugcucguggucccaugcagaaaccaagaugaacugauugguagagcccgaauuucucagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6776 - RNA, 9876 nt, Artificial Sequence
  derived and/or modified CDS sequence (wt) from DENV-2__EU569718__SS-prME
acagcaggcgugauuauuauguugauuccaacagcaauggcguuccauuuaaccacacguaauggagaaccacacaugaucguugguaggcaagagaaagggaaaagucuucuguucaaaacagaggaugguguuaacaugugcacccucauggccauagaccuuggugaauugugugaagauacaaucacguacaaguguccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauacaccauaggaacgacacauuuccaaagggccuugauuuucaucuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucauuuguaaacacuccaugguagacagaggauggggaaauggauguggauuauuuggaaaaggaggcauugugaccugugcuauguucacaugcaaaaagaacauggaaggaaaagucgugcugccagaaaaucuggaauacaccaucgugauaacaccucacucaggagaagaguacgcuguagguaaugacacaggaaaacauggcaaggaaauuaaaauaacaccacagaguuccaucacagaagcagaacugacaggcuauggcacuguuacgauggagugcucuccgagaacgggccucgacuucaaugaaauggugcugcugcagauggaagacaaagccuggcuggugcacaggcaaugguuccuagaccugccguuaccauggcuacccggagcggacacacaaggaucaaauuggauacagaaagagacauuggucacuuucaaaaauccccacgcgaagaaacaggauguuguuguuuuaggaucucaagaaggggccaugcacacggcacuuacaggggccacagaaauccagaugucaucaggaaacuuacuguucacaggacaucucaaguguaggcugagaauggacaaacuacagcucaaaggaaugucauacucuauguguacaggaaaguuuaaaauugugaaggaaauagcagaaacacaacauggaacaauaguuaucagaguacaauaugaaggggacggcucuccauguaagaucccuuuugagauaauggauuuggaaaaaagacacgucuuaggucgccugauuacaguuaacccaaucguaacagaaaaagauagcccagucaacguagaagcagaaccuccauucggagacagcuacaucaucauaggaguagagccgggacaauugaaacucaauugguucaagaagggaaguucuauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggagucaucaucacauggauaggaaugaauucacguagcaccucacuaucugugucacuaguauuggugggagucgugacacuguacuugggaguuauggugcaggcugauagugguugcguugugagcuggaaaaauaaagaacugaaauguggcagcgggaucuucauuacagauaacgugcacacauggacagaacaauauaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaacucgcuggaaguugaagacuaugguuuugggguuuuuuccaccaauauauggcuaaaacugagagaaaaacaggauguauuuugugacucaaaacucaugucagcggccauaaaagacaacagagccguccaugccgauauggguuauuggauagaaagugcacucaaugacacauggaagauggagaaagccucuuucauugaagucaaaagcugccacuggccaaagucacacacccucuggagcaauggaguauuggaaagugagaugauaaucccaaaaaauuuugccgggccagugucacaacacaacuacagaccaggcuaccauacacaaacagcaggaccuuggcaucuaggaaagcucgagauggacuucgauuucugcgaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucacuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugaugguuauggugggcgcuaccaugacggaugacauagguaugggagugacuuaccuugcccuacuagcagcuuucaaaguuagaccaacuuuugcagcuggacuacucuugagaaaauugaccuccaaggaacuaaugauggccaccauaggaaucgcacuccuuucccaaagcaccauaccagagaccauucuugaacugacugaugcguuagccuugggcaugaugguccucaaaauagugagaaauauggaaaaguaccaacuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccacuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauucccaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaagaagaacaaacacugaccauacucaucagaacgggauugcuggugaucucaggagucuuuccaguaucgauaccaaucacggcagcagcaugguaccugugggaagugaaaaaacaacgggcuggaguguugugggacgucccuucacccccaccagugggaaaagccgaacuggaagauggagccuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuggcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuaugguaaugguguugucacaaggaguggagcauaugugagugcuauagcccagaccgaaaaaagcauugaagacaauccagagaucgaagaugacauuuuccgaaagaaaagauugaccaucauggaccuccauccaggagcaggaaagacaaaaagauaccuuccagccauaguuagagaagccauaaagcguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugucaugccacauuuacuaugaggcugcuaucaccagucagagugccaaauuacaaccugaucaucauggacgaagcccacuucacagacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagccgcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggugaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagcuaaaaugcucuuagauaacaucaacacaccugaaggaaucauuccuaguauguucgaaccagagcgugaaaagguggaugccauugauggugaauaccguuugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuauucugacccacuggcacugaaagaauucaaggaauuugcagcuggaagaaaaucuuugacccugaaccuaaucacagaaaugggcaggcuuccaacuuucaugacucagaaggcaagagacgcacuggacaacuuagcugugcugcauacggcugagguagguggaaaggcguacaaucaugcucucagugaacugccggagacccuggagacacugcuuuuacugacacuccuggccacagucacaggaggaaucuucuuauucuuaaugagcggaaaagguauagggaagaugacccugggaauguguuguauaaucacggccaguauccuccuaugguaugcacagauacaaccacacuggauagcagcuucaauaauacuggaguuuuuccucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauccuggacauagaucuacguccugcaucagcauggacgcuguaugccguggcuacaacauuugucacaccaauguugagacauagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuuuuacugguagcacauuaugccauuauagggccaggacuucaagcaaaagcaaccagagaagcucagaaaagagcagcagcaggcaucaugaaaaacccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguuuuggaacacuaccauugcaguaucaauggcuaacaucuuuagggggagcuacuuggccggagcuggacuccucuuuuccaucaugaagaacacaacaaacacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaaaaauguaagagaagucaaaggccugacaaaaggaggaccaggacacgaagaacccauccccaugucaacauauggguggaaucuagugcgucugcaaaguggaguugacguuuucuucaccccgccagaaaagugugacacauuguugugugacauaggggagucgucaccaaaucccacgauagaagcaggacgaacacucagaguccucaacuuaguggaaaauugguugaacaauaacacccaauucugcauaaagguucucaacccauauaugcccucagucauagaaaaaauggaaacacuacaaaggaaauauggaggagccuuggugaggaauccacucucacgaaacuccacacaugagauguacuggguauccaaugcuacugggaacauagugucaucagugaacaugauuucaaggauguugauuaacagauucacaaugaaacacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggagucgucagacugcugacaaaaccuugggacgucgucccuauggugacacagauggcaaugacagacacgacuccauuuggacaacaacgcguuuucaaagagaaaguagacacgagaacccaagaaccgaaggaaggcacaaagaaacugaugagaauuacggcagaguggcuuuggaaagaacuaggaaagaaaaagacaccuaggauguguaccagagaagaauuuacaagaaaggugagaagcaaugcagccuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaacucccugaguggaguggaaggagaagggcugcacaagcuaggcuacauuuuaagagacgugagcaagaaggaagggggagcaauguacgccgaugauacagcaggaugggacacaagaaucacacuagaagacuuaaaaaaugaagaaaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagaaaucgcuguacagaacugguuagcaagaguggggcgugaaaggcuaucaagaauggccaucaguggagaugauugcguuguaaaaccuuuagaugacagauuugcaagugcuuuaacagcucuaaaugacaugggaaaaguuaggaaagauauacaacaaugggaaccuucaagaggauggaacgauuggacacaagugccuuucuguucacaccauuuccaugaguuagucaugaaagauggucgcgugcucguggucccaugcagaaaccaagaugaacugauugguagagcccgaauuucccagggagccggguggucuuugaaggagacggccuguuuggggaagucuuacgcccaaauguggacccugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuggggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaagagauucagaaaggaagaggaagaggcagguguccugugguag

SEQ ID NO: 6777 - RNA, 9876 nt, Artificial Sequence
  derived and/or modified CDS sequence (wt) from DENV-2__EU596488__SS-prME
acagcaggcgugauuauuauguugauuccaacaguaauggcguuccauuuaaccacacguaauggagaaccacacaugaucguugguaggcaagagaaagggaaaagucuucuguucaaaacagaggaugguguuaacauguguacccucauggccauagaccuuggugaauugugugaagauacaaucacguacaagugcccccuccucaggcaaaaugaaccagaagacauagauuguuggugcaacucuacguccacauggguaacuuaugggacauguaccaccacaggagaacacagaagagaaaaaagaucaguggcacucguuccacaugugggcaugggacuggagacacgaacugaaacauggaugucaucagaaggggccuggaaacauguucagagaauugaaaccuggaucuugagacauccaggcuuuaccauaauggcagcaauccuggcauauaccauaggaacgacacauuuccaaagggcucugaucuucauuuuacugacagccgucgcuccuucaaugacaaugcguugcauaggaauaucaaauagagacuucguagaagggguuucaggaggaaguuggguugacauagucuuagaacauggaaguugugugacgacgauggcaaaaaauaaaccaacauuggauuuugaacugauaaaaacagaagccaaacaaccugccacucuaaggaaguacuguauagaagcaaagcugaccaauacaacaacagaaucucguugcccaacacaaggggaacccagucuaaaugaagagcaggacaaaagguucaucugcaaacacuccaugguagacagaggauggggaaauggauguggauuauuuggaaaaggaggcauuguaaccugugcuauguucacaugcaaaaagaacauggaaggaaaaguugugcugccagaaaaucuggaauacaccaucgugauaacaccucacucaggagaagagcacgcuguagguaaugacacaggaaaacauggcaaggaaauuaaaauaacaccacagaguuccaucacagaagcagaacugacaggcuauggcacugucacgauggagugcucuccgagaacgggccucgacuucaaugagauggugcugcugcagauggaagacaaagccuggcuggugcacaggcaaugguuccuagaucugccguuaccauggcuacccggagcggacacacaaggaucaaauuggauacagaaagagacguuggucacuuucaaaaauccccacgcgaagaaacaggacgucguuguuuuaggaucucaagaaggggccaugcacacggcacuuacaggggccacagaaauccagaugucaucaggaaacuuacuguucacaggacaucucaaguguaggcugagaauggacaaauuacagcuuaaaggaaugucauacucuauguguacaggaaaguuuaaaauugugaaggaaauagcagaaacacaacauggaacaauaguuaucagaguacaauaugaaggggacggcucuccauguaagauuccuuuugagauaauggauuuagaaaaaagacacguccuaggucgccugauuacagugaacccaaucguaacagaaaaagauagcccagucaacauagaagcagaaccuccauucggagacagcuacaucaucauaggaguagagccgggacaauugaaacucaauugguucaagaagggaaguuccauuggccaaauguuugagacaacaaugagaggagcgaagagaauggccauuuuaggugacacagccugggauuuuggaucccugggaggaguguuuacaucuauaggaaaggcucuccaccaaguuuucggagcaaucuauggggcugcuuuuaguggggucucauggacuaugaaaauccucauaggaguuaucaucacauggauaggaaugaauucacguagcaccucacugucugugucacuaguauuggugggagucgugacacuguacuuggggguuauggugcaggcugauacugguugcguugugagcuggaaaaauaaagaacugaaauguggcagcgggaucuucauuacagauaacgugcacacauggacagaacaauacaaguuccaaccagaauccccuucaaaacuagcuucagcuauccaaaaagcucaugaagagggcauuuguggaauccgcucaguaacaagauuggagaaucugauguggaaacaaauaacaccagaauugaaucacauucuaucagaaaaugagguaaaguugaccauuaugacaggagacauuaaaggaaucaugcaggcaggaaaacgaucuuugcggccccagcccacugagcugaaguacucauggaaaacauggggaaaggcgaaaaugcucuccacagagucucacaaucagaccuuucuuauugauggcccugaaacagcagaaugccccaacacaaacagagcuuggaauucgcuggaaguugaagacuaugguuuuggaguuuuuuccacaaauauauggcuaaaacugagagaaaaacaggauguauuuugugacucaaaacuuaugucagcggccauaaaagacaacagagccguccaugccgauauggguuauuggauagaaagugcacucaaugacacauggaagauggagaaagccucuuucauugaaaucaaaagcugccacuggccaaagucgcacacccucuggagcaauggaguauuggaaagugagaugauaaucccaaaaaauuuugccgggccagugucacaacacaacuacagaccaggcuaccacacacaaacagcaggaccuuggcaccuagguaagcucgagauggacuucgauuucugugaaggaaccacagugguggugacugaggacuguggaaauagaggacccucuuuaagaacgaccacugccucuggaaaacucauaacagaauggugcugccgauccugcacacuaccaccucuaagauacagaggugaggauggaugcugguacgggauggaaaucagaccauugaaagagaaagaggagaaucuggucaacuccuuggucacagccggacaugggcagauugauaacuuuucauuaggagucuugggaauggcucuguuccuggaagaaaugcucaggacccgaguaggaacgaaacaugcaauacugcuaguugcaguaucuuucgugacauugauuaccgggaacauguccuuuagagaccugggaagagugauggucauggugggcgcuacuaugacggaugacauagguaugggagugacuuaccuugcccuacuagcagccuucaaaguuagaccaacuuuugcagcuggacuacucuugagaaaauugaccuccaaggaacuaaugauggccacuauaggaaucgcacuccuuucccaaagcaccauaccagagaccauucuugaacugacugaugcguuagccuugggcaugaugguccucaaaauagugagaaauauggaaaaguaccaauuggcagugacuaucauggcuaucucgugugucccaaaugcagugauauugcaaaacgcauggaaggugaguugcacaauauuggcagcgguguccguuucuccauugcucuuaacauccucacaacagaaagcggauuggauaccauuggcauugacgauaaaaggucucaauccaacagccaucuuucuaacaacucuuucgagaaccagcaagaaaaggagcuggccgcuaaaugaagcugucauggcagucgggauggugagcauuuuagccaguucucuccuaaagaaugacauuccuaugacagguccauuaguggcuggagggcuucuuacuguguguuacgugcucacuggacgaucggccgauuuggaacuggagagagcugccgauguaaaaugggaagaucaggcagaaauaucaggaagcagcccaauccugucaauaacaauaucagaagauggcagcaugucgauaaaaaaugaagaggaagaacauacacugaccauacuaaucagaacggguuugcuggugaucucaggagucuuuccaguaucgauaccaauuacagcagcagcaugguaccugugggaagugaaaaaacaacgggcuggaguguugugggacgucccuucacccccaccagugggaaaagccgaacuggaagauggagcuuauagaaucaagcaaagagggauuuuuggauauucucagauuggagccggaguuuacaaagaaggaacauuccauacaauguggcacgucacacguggugcuguucugaugcauagagggaagaggauugaaccaucaugggcagacgucaagaaagaccuaauaucauauggaggaggcuggaagcuagaaggagaauggaaagaaggagaggaaguccaagucuuagcauuggaaccuggaaaaaauccaagagccguccaaacgaaaccuggacuuuucaaaaccaauaccggaaccauaggcgccguaucucuggacuuuuccccuggaacgucaggaucuccaauugucgacagaaaaggaaaaguugugggucuuuacgguaaugguguuguuacaaggaguggagcauaugugagugccauagcccagaccgaaaaaagcauugaagacaauccagagaucgaagaugacauuuuccgaaagaaaagauugaccaucauggaucuccauccaggagcaggaaagacaaaaagauaccuuccagccauaguuagagaagccauaaaacguggcuugagaacauuaauccuggcucccacuagaguuguggcagcugaaauggaggaagcucuuagaggacuuccaauaagauaccaaaccccagccaucagagccgagcacaccgggcgggagaucguggaccuaaugugccaugccacauuuacuaugaggcugcuaucaccagucagagugccaaauuacaaccugaucaucauggacgaagcucacuucacggacccagcaaguauagcagcuagaggauauauuucaacucgaguagagaugggugaagcagccgggauuuucaugacagccacuccuccgggaaguagagacccauuuccucagagcaaugcaccaaucauggaugaggaaagagaaaucccugagcgcucguggaauucaggucaugaaugggucacggacuucaaagggaagacuguuugguuuguuccaaguauaaaagcaggaaaugacauagcagcuugucuuagaaaaaauggaaagaaagugauacaacucaguaggaagacuuuugacucugaguauguuaagacuagagccaaugauugggacuuuguggucacaacugacauuucagaaaugggugccaacuucagggcugagaggguuauagaccccagacguugcaugaaaccaguuauacuaacagauggcgaagagcgggucaucuuggcaggaccuaugccagugacccacucuagugcagcgcaaagaagagggagaauaggaagaaauccaaaaaaugaaaaugaccaguacauauacaugggagaaccucuggaaaaugaugaagacugugcacauuggaaagaagccaaaaugcucuuagauaacaucaacacaccugaaggaaucauuccuagcauguucgaaccagagcgugaaaaaguggaugccauugauggugaauaccgucugagaggagaagcaaggaaaaccuuuguggaccuaaugagaagaggggacuuaccagucugguuggccuacagaguggcagcugaaggcaucaacuacgcagacagaaggugguguuuugauggaauuaagaacaaccaaauacuggaagaaaacguggaaguggaaaucuggacaaaagaaggggaaaggaagaaauuaaaacccagaugguuggaugcuaggaucuacucugacccacuggcacugaaagaauucaaggaauuugcagcuggaagaaaaucuuugacccugaaccuaaucacagaaaugggcaggcuuccaacuuuuaugacucagaaggcaagagacgcacuggacaacuuagcugugcugcauacggcugagguagguggaagggcuuacaaucaugcucucagugaacugccggagacccuggagacacugcuuuuacugacacuccuggccacagucacaggaggaaucuucuuauucuuaaugagcggaaaagguaucgggaagaugacccugggaauguguuguauaaucacggcuaguauccuccuaugguaugcacagauacaaccacacuggauagcagcuucaauaauacuggaguuuuuucucauaguuuugcucauuccagaaccagaaaaacagagaacaccccaagacaaccaauugaccuacguagucauagccauccucacagugguggccgcaaccauggcaaaugagauggguuuccuggaaaaaaccaagaaagaccucggauugggaagcauuacaacccaggaaucugagagcaacauucuggacauagaucuacguccugcaucagcauggacgcuguaugccguggcuacaacauuugucacaccaauguugagacacagcauugaaaauuccucagugaaugucucccuaacagccauugcuaaccaagccacagugcuaaugggucuugggagaggauggccauugucaaagauggacaucggaguuccccuccuugccauuggaugcuauucacaagucaacccuauaacucucacagcagcucuucuucuacugguagcacauuaugccauuauagggccaggacuucaagcaaaagcaaccagagaagcucagaaaagaacagcagcaggcaucaugaaaaauccaacagucgauggaauaacagugauugaccuagaaccaauacccuaugauccaaaauuugaaaagcaguuaggacaaguaaugcuccuaguccucugcgugacucaaguauuaaugaugaggacuacaugggcucugugugaggcucuaaccuuagcgacagggcccaucuccacacugugggaaggaaauccagggagguucuggaacacuaccauugcagugucaauggcuaacaucuuuagggggagcuacuuggccggagcuggacuccucuuuuccaucaugaagaacacaauaaauacaagaagaggaacuggcaacauaggagagacacuuggagaaaaauggaaaagccgauuaaacgcacugggaaaaagugaauuucagaucuacaagaaaaguggaauccaggaaguggauagaaccuuagcaaaagaaggcaucaaaagaggagaaacggaccaccacgcugugucgcgaggcucagcaaaacugagaugguucgucgagagaaacauggucacaccagaagggaaggugguggaccucgguugcggcagagggggcuggucauacuauugugggggacuaaagaauguaagagaagucaaaggccugacaaaaggaggaccaggacaugaagaacccauccccaugucaacauauggguggaaucuagugcgucugcaaaguggaguugacguuuucuucaccccgccagaaaagugugacacauugcugugugacauaggggaaucgucaccaaaucccacgauagaagcaggacgaacacuuagaguccucaacuuaguggaaaauugguugaacaauaacacccaauuuugcguaaagguucucaacccauauaugcccucagucauagaaaaaauggaaacacuacaaaggaaauauggaggagccuuggugaggaauccacucucacgaaacuccacacaugagauguacuggguauccaaugcuaccgggaacauagugucaucagugaacaugauuucaaggauguugauuaacagauucacaaugaagcacaagaaagccacuuacgagccagauguugaccuaggaagcggaacccgcaacauuggaauugaaaaugagauaccaaaucuagacauaauaggaaagagaauagagaaaauaaagcaagagcaugaaacaucauggcacuaugaccaagaccacccauacaaaacgugggcuuaccauggcagcuaugaaacaaaacaaacuggaucagcaucaucuauggugaacggaguugucaaacugcugacaaaaccuugggacguugucccuauggugacacagauggcaaugacagacacgacuccauuuggacaacaacgcguuuucaaagagaaaguggauacgagaacccaagaaccgaaggaaggcacaaagaaacugaugagaaucacggcagaguggcuuuggaaagaacuaggaaagaaaaagacacccaggauguguaccagagaagaauuuacaagaaaggugagaagcaaugcagcuuugggggccauauucacugaugagaacaaauggaaaucggcucgugaggcuguugaagauaguagguuuugggagcugguugacagggaaagaaaucuccaucuugaaggaaagugugaaacauguguguacaacaugauggggaaaagagagaagaaacuaggggaguucggcaaggcaaaagguagcagagccauaugguacauguggcuuggagcacgcuucuuagaguuugaagcccuaggauucuugaaugaagaucacugguucuccagagggaauucccugaguggaguggaaggagaagggcugcacaagcuaggcuacauuuuaagagaugugagcaagaaggaagggggagcaauguacgccgaugacacagcaggaugggacacaagaaucacacuagaagacuuaaaaaaugaagagaugguaacaaaccacaugaaaggagaacacaagaaacuagccgaggccauauucaaauuaacguaccaaaacaagguggugcgugugcaaagaccaacaccaagaggcacaguaauggacaucauaucgagaaaagaccaaagaggcagcgggcaagucggcaccuauggccuuaauacuuucaccaacauggaagcccaauuaauuagacagauggagggagaaggaauuuuuaaaagcauucagcgccugacagucacagaagagaucgcugugcagaacugguuagcaagaguggggcgugaaagguuaucaagaauggccaucaguggagaugauugcguuguaaaaccuuuagaugacagauuugcaagugcuuuaacagcccuaaaugacaugggaaaaguuaggaaagauauacaacaaugggaaccuucaagaggauggaacgauuggacacaagugccuuucuguucacaucauuuccaugagcuagucaugaaagauggucgcgugcucguggucccaugcagaaaccaagaugaacugauugguagagcccgaauuucccagggagccggguggucuuugaaggagacggccuguuuggggaagucuuacgcccaaauguggaccuugauguacuuccacagacgugaccucagacuggcggcaaaugccauuugcucggcagucccgucacauuggguuccaacaagucgaacaaccugguccauacacgcuaagcaugaauggaugacgacggaagacaugcuggcagucuggaacaggguguggauccaagaaaacccguggauggaagacaaaacuccaguggaaucaugggaagaagucccauacuuagggaaaagagaagaccaauggugcggcucauugauugggcuaacaagcagggccaccugggcaaagaacauccaaacagcgauaaaucaagucagaucccuuauaggcaaugaggaauacacagacuacaugccauccaugaaaagauucagaaaggaagaggaagaggcaggaguccugugguag
